(12) United States Patent
Kolkman et al.

(10) Patent No.: US 8,629,244 B2
(45) Date of Patent: Jan. 14, 2014

(54) INTERLEUKIN-6 RECEPTOR BINDING POLYPEPTIDES

(75) Inventors: Joost Alexander Kolkman, Sint-Martens-Latem (BE); Els Anna Alice Beirnaert, Bellem (BE)

(73) Assignee: Ablynx N.V., Zwijnaarde (BE)

( * ) Notice: Subject to any disclaimer, the term of this patent is extended or adjusted under 35 U.S.C. 154(b) by 759 days.

(21) Appl. No.: 12/310,223

(22) PCT Filed: Aug. 17, 2007

(86) PCT No.: PCT/EP2007/058587
§ 371 (c)(1),
(2), (4) Date: Dec. 8, 2009

(87) PCT Pub. No.: WO2008/020079
PCT Pub. Date: Feb. 21, 2008

(65) Prior Publication Data
US 2010/0215664 A1    Aug. 26, 2010

Related U.S. Application Data

(60) Provisional application No. 60/838,904, filed on Aug. 18, 2006, provisional application No. 60/873,012, filed on Dec. 5, 2006, provisional application No. 60/938,325, filed on May 16, 2007.

(51) Int. Cl.
*C07K 16/18* (2006.01)
*C07K 16/28* (2006.01)
*C07K 7/00* (2006.01)
*C07K 14/435* (2006.01)
*A61K 39/395* (2006.01)

(52) U.S. Cl.
USPC ....... 530/387.1; 435/69.1; 530/300; 530/324; 530/350; 530/387.3; 530/391.1; 536/23.53

(58) Field of Classification Search
None
See application file for complete search history.

(56) References Cited

U.S. PATENT DOCUMENTS

| | | | |
|---|---|---|---|
| 5,888,510 A * | 3/1999 | Kishimoto et al. | 424/141.1 |
| 2007/0036785 A1 | 2/2007 | Kishimoto et al. | |
| 2007/0280945 A1 | 12/2007 | Stevens et al. | |
| 2011/0243954 A1 | 10/2011 | Revets et al. | |
| 2012/0077731 A1 | 3/2012 | Beirnaert et al. | |
| 2012/0171209 A1 | 7/2012 | Compernolle et al. | |
| 2012/0244158 A1 | 9/2012 | Brige et al. | |

FOREIGN PATENT DOCUMENTS

| | | | |
|---|---|---|---|
| CN | 1535728 A | | 10/2004 |
| EP | 0257406 A2 | | 3/1988 |
| EP | 0312996 A2 | | 4/1989 |
| EP | 0325474 A2 | | 7/1989 |
| EP | 0409607 A2 | | 1/1991 |
| EP | 0 411 946 A2 | | 2/1991 |
| EP | 0572118 A1 | | 12/1993 |
| EP | 0 527 809 B1 | | 8/1995 |
| EP | 0 409 607 B1 | | 10/1996 |
| EP | 0 628 639 B1 | | 6/1999 |
| JP | 2000/500644 A | | 1/2000 |
| WO | WO 2005/003345 A2 | | 1/2005 |
| WO | WO 2006/023144 A2 | | 3/2006 |
| WO | WO 2006/079372 A1 | | 8/2006 |
| WO | WO 2007/042289 A2 | | 4/2007 |
| WO | WO 2007/104529 A2 | | 9/2007 |
| WO | WO 2008/020079 A1 | | 2/2008 |
| WO | WO 2008/071685 A1 | | 6/2008 |
| WO | WO 2008/074840 A2 | | 6/2008 |
| WO | 2008/077945 A2 | | 7/2008 |
| WO | 2009/010539 A2 | | 1/2009 |
| WO | WO 2009/004065 A2 | | 1/2009 |
| WO | WO 2010/115995 A2 | | 10/2010 |

OTHER PUBLICATIONS

Lederman et al. Mol Immunol, 1991, vol. 28, pp. 1171-1181.*
Li et al. Proc Natl Acad Sci USA, 1980, vol. 77, pp. 3211-3214.*
Atreya et al., Blockade of interleukin 6 trans signaling suppresses T-cell resistance against apoptosis in chronic intestinal inflammation: evidence in crohn disease and experimental colitis in vivo. Nat Med. May 2000;6(5):583-8. Erratum in: Nat Med. Nov. 2010;16(11):1341.
Bataille et al., Biologic effects of anti-interleukin-6 murine monoclonal antibody in advanced multiple myeloma. Blood. Jul. 15, 1995;86(2):685-91.
Beck et al., Brief report: alleviation of systemic manifestations of Castleman's disease by monoclonal anti-interleukin-6 antibody. N Engl J Med. Mar. 3, 1994;330(9):602-5.
Becker et al., TGF-beta suppresses tumor progression in colon cancer by inhibition of IL-6 trans-signaling. Immunity. Oct. 2004;21(4):491-501.
Doganci et al., The IL-6R alpha chain controls lung CD4+CD25+ Treg development and function during allergic airway inflammation in vivo. J Clin Invest. Feb. 2005;115(2):313-25. Erratum in: J Clin Invest. May 2005;115(5):1388. Lehr, Hans A [added].
Emilie et al., Administration of an anti-interleukin-6 monoclonal antibody to patients with acquired immunodeficiency syndrome and lymphoma: effect on lymphoma growth and on B clinical symptoms. Blood. Oct. 15, 1994;84(8):2472-9.
Hirano et al., Interleukin 6 and its receptor in the immune response and hematopoiesis. Int J Cell Cloning. Jan. 1990;8 Suppl 1:155-66; discussion 166-7.

(Continued)

*Primary Examiner* — Bridget E Bunner
*Assistant Examiner* — Fozia Hamud
(74) *Attorney, Agent, or Firm* — Wolf, Greenfield & Sacks, P.C.

(57) ABSTRACT

The invention relates to amino acid sequences that are directed against and/or that can specifically bind to IL-6 receptor, compounds or constructs that comprise said amino acid sequence, nucleic acids that encode said amino acid sequences, compounds or constructs, pharmaceutical compositions comprising said amino acid sequences, compounds or constructs as well as methods for the prevention and/or treatment of diseases and disorders associated with IL-6 receptor.

22 Claims, 62 Drawing Sheets

(56) References Cited

OTHER PUBLICATIONS

Jang et al., Pharmacokinetic/pharmacodynamic (PK/PD) modeling and trial simulations to guide dose selection with CNTO 328, a chimeric anti-IL-6 monoclonal antibody (Mab), in patients with renal cell carcinoma (RCC). Journal of Clinical Oncology, 2004 ASCO Annual Meeting Proceedings (Post-Meeting Edition). 2004;22(14S, Jul. 15 Supplement):2608. Abstract.

Klein et al., Murine anti-interleukin-6 monoclonal antibody therapy for a patient with plasma cell leukemia. Blood. Sep. 1, 1991;78(5):1198-204.

Nowell et al., Soluble IL-6 receptor governs IL-6 activity in experimental arthritis: blockade of arthritis severity by soluble glycoprotein 130. J Immunol. Sep. 15, 2003;171(6):3202-9.

Prabhakar et al., Correlation of serum CNTO 328-Anti IL-6 monoclonal antibody (Mab) concentrations and biomarker expression in renal cell carcinoma (RCC) patients. Journal of Clinical Oncology, 2004 ASCO Annual Meeting Proceedings (Post-Meeting Edition). 2004;22(14S, Jul. 15 Supplement):2560. Abstract.

Wendling et al., Treatment of severe rheumatoid arthritis by anti-interleukin 6 monoclonal antibody. J Rheumatol. Feb. 1993;20(2):259-62.

Woo et al., Open label phase II trial of single, ascending doses of MRA in Caucasian children with severe systemic juvenile idiopathic arthritis: proof of principle of the efficacy of IL-6 receptor blockade in this type of arthritis and demonstration of prolonged clinical improvement. Arthritis Res Ther. 2005;7(6):R1281-8. Epub Sep. 15, 2005.

Zaki et al., CNTO 328, a monoclonal antibody to IL-6, inhibits human tumor-induced cachexia in nude mice. Int J Cancer. Sep. 10, 2004;111(4):592-5.

Boulanger et al., Hexameric structure and assembly of the interleukin-6/IL-6 alpha-receptor/gp130 complex. Science. Jun. 27, 2003;300(5628):2101-4. Erratum in: Science. Aug. 15, 2003;301(5635):918.

Campbell et al., Essential role for interferon-gamma and interleukin-6 in autoimmune insulin-dependent diabetes in NOD/Wehi mice. J Clin Invest. Feb. 1991;87(2):739-42.

Choy et al., Therapeutic benefit of blocking interleukin-6 activity with an anti-interleukin-6 receptor monoclonal antibody in rheumatoid arthritis: a randomized, double-blind, placebo-controlled, dose-escalation trial. Arthritis Rheum. Dec. 2002;46(12):3143-50.

Grau et al., Interleukin 6 production in experimental cerebral malaria: modulation by anticytokine antibodies and possible role in hypergammaglobulinemia. J Exp Med. Nov. 1, 1990;172(5):1505-8.

Hirano et al., Purification to homogeneity and characterization of human B-cell differentiation factor (BCDF or BSFp-2). Proc Natl Acad Sci U S A. Aug. 1985;82(16):5490-4.

Holliger et al., Engineered antibody fragments and the rise of single domains. Nat Biotechnol. Sep. 2005;23(9):1126-36.

Ishihara et al., IL-6 in autoimmune disease and chronic inflammatory proliferative disease. Cytokine Growth Factor Rev. Aug.-Oct. 2002;13(4-5):357-68.

Ito et al., A pilot randomized trial of a human anti-interleukin-6 receptor monoclonal antibody in active Crohn's disease. Gastroenterology. 2004;126:989-96.

Jilka et al., Increased osteoclast development after estrogen loss: mediation by interleukin-6. Science. Jul. 3, 1992;257(5066):88-91.

Nishimoto et al., Humanized anti-interleukin-6 receptor antibody treatment of multicentric Castleman disease. Blood. Oct. 15, 2005;106(8):2627-32. Epub Jul. 5, 2005.

Revets et al., Nanobodies as novel agents for cancer therapy. Expert Opin Biol Ther. Jan. 2005;5(1):111-24.

Roodman, Interleukin 6. A potential autocrine/paracrine factor in Paget's disease of bone. J Clin Invest. Jan. 1992;89(1):46-52.

Saito et al., Preparation of monoclonal antibodies against the IL-6 signal transducer, gp130, that can inhibit IL-6-mediated functions. J Immunol Methods. Aug. 9, 1993;163(2):217-23.

Starnes et al., Anti-IL-6 monoclonal antibodies protect against lethal *Escherichia coli* infection and lethal tumor necrosis factor-alpha challenge in mice [retraction of Starnes HF Jr, Pearce MK, Tewari A, Yim JH, Zou JC, Abrams JS. In: J Immunol Dec. 15, 1990;145(12):4185-91]. J Immunol. Mar. 15, 1992;148(6):1968.

Strassman et al., Evidence for the involvement of interleukin 6 in experimental cancer cachexia. J Clin Invest. May 1992;89:1681-1684.

Taga et al., Interleukin-6 triggers the association of its receptor with a possible signal transducer, gp130. Cell. Aug. 11, 1989;58(3):573-81.

Yamasaki et al., Cloning and expression of the human interleukin-6 (BSF-2/IFN beta 2) receptor. Science. Aug. 12, 1988;241(4867):825-8.

Desmyter et al., Antigen specificity and high affinity binding provided by one single loop of a camel single-domain antibody. J Biol Chem. Jul. 13, 2001;276(28):26285-90. Epub May 7, 2001.

Emilie et al., Cytokines in HIV infection. Int J Immunopharmacol. May-Jun. 1994;16(5-6):391-6.

Gaillard et al., Identification of a novel antigenic structure of the human receptor for interleukin-6 involved in the interaction with the glycoprotein 130 chain. Immunology. Sep. 1996;89(1):135-41.

Hirano et al., Biological and clinical aspects of interleukin 6. Immunol Today. Dec. 1990;11(12):443-9.

Ishihara et al., Molecular basis of the cell specificity of cytokine action. Biochim Biophys Acta. Nov. 11, 2002;1592(3):281-96.

Kalai et al., Participation of two Ser-Ser-Phe-Tyr repeats in interleukin-6 (IL-6)-binding sites of the human IL-6 receptor. Eur J Biochem. Jun. 15, 1996;238(3):714-23.

Kipriyanov, Generation of bispecific and tandem diabodies. Methods Mol Biol. 2009;562:177-93.

Muyldermans et al., Unique single-domain antigen binding fragments derived from naturally occurring camel heavy-chain antibodies. J Mol Recognit. Mar.-Apr. 1999;12(2):131-40.

Rajpal et al., A general method for greatly improving the affinity of antibodies by using combinatorial libraries. Proc Natl Acad Sci U S A. Jun. 14, 2005;102(24):8466-71. Epub Jun. 6, 2005.

Roodman, Interleukin-6: an osteotropic factor? J Bone Miner Res. May 1992;7(5):475-8.

Shinkura et al., In vivo blocking effects of a humanized antibody to human interleukin-6 receptor on interleukin-6 function in primates. Anticancer Res. Mar.-Apr. 1998;18(2A):1217-21.

Vierboom et al., Preclinical evaluation of anti-rheumatic drugs in a non-human primate model of arthritic disease. Drug Discovery Today: Disease Models. 2008; 30(20):e1-7. doi.10.1016/j.ddmod.2008.06.003.

Wesolowski et al., Single domain antibodies: promising experimental and therapeutic tools in infection and immunity. Med Microbiol Immunol. Aug. 2009;198(3):157-74. doi: 10.1007/s00430-009-0116-7. Epub Jun. 16, 2009.

Colman, Effects of amino acid sequence changes on antibody-antigen interactions. Res Immunol. Jan. 1994; 145(1):33-6.

Paul, Fundamental immunology, 3rd Edition, 1993: 292-295, under the heading "Fv structure and diversity in three dimensions.".

Riechmann et al., Single domain antibodies: comparison of camel VH and camelised human VH domains. J Immunol Methods. Dec. 10, 1999; 231(1-2):25-38.

Roitt et al., Immunology. 5$^{th}$ edition. 1998; 80-81, 107. (translation of 110-111, 150 from Russian-language version of Roitt et al., Immunology).

Rudikoff et al., Single amino acid substitution altering antigen-binding specificity. Proc Natl Acad Sci U S A. Mar. 1982; 79(6):1979-83.

Jones et al., Replacing the complementarity-determining regions in a human antibody with those from a mouse. Nature. May 29-Jun. 4, 1986; 321(6069):522-5.

Jones et al., Therapeutic strategies for the clinical blockade of IL 6/gp130 signaling. J Clin Invest. Sep. 2011; 121(9):3375-83. doi: 10.1172/JCI57158. Epub Sep. 1, 2011.

Robert et al., Tumor targeting with newly designed biparatopic antibodies directed against two different epitopes of the carcinoembryonic antigen (CES). Int J Cancer. Apr. 12, 1999; 81(2):285-91.

Scheller et al., Interleukin-6 and its receptor: from bench to bedside. Med Microbiol Immunol. Dec. 2006; 195(4):173-83. Epub May 31, 2006.

Tanaka et al., Targeting interleukin-6: all the way to treat autoimmune and inflammatory diseases. Int J Biol Sci. 2012; 8(9):1227-36. doi: 10.7150/ijbs.4666. Epub Oct. 24, 2012.

* cited by examiner

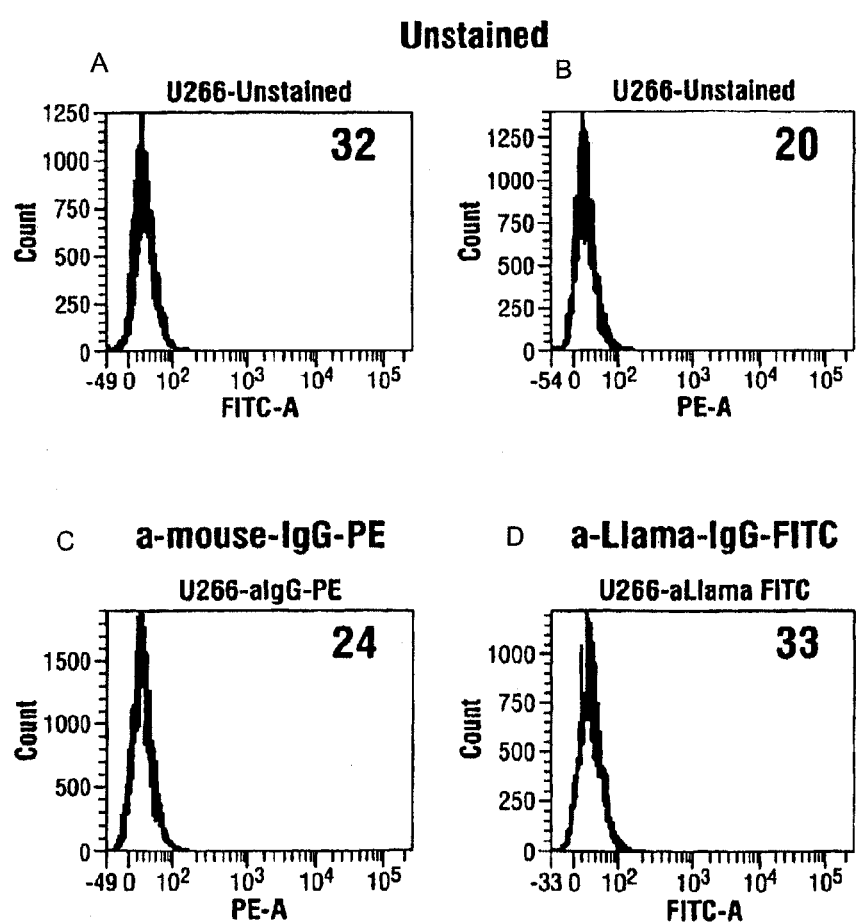

Fig. 2A
*U266B1*
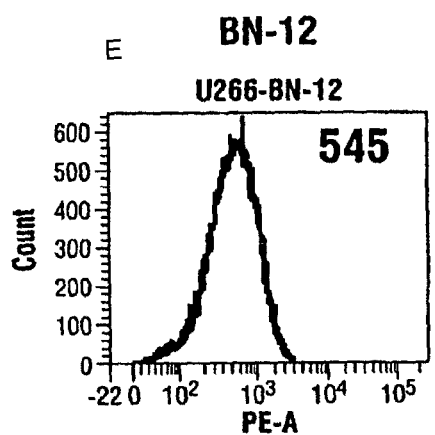
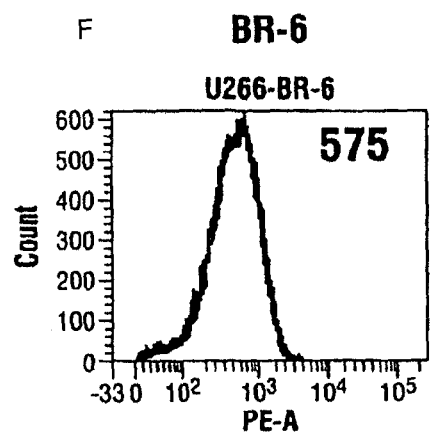
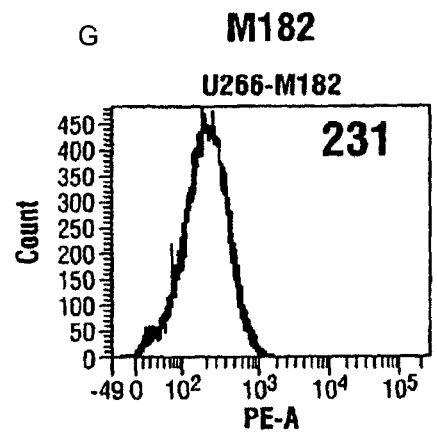

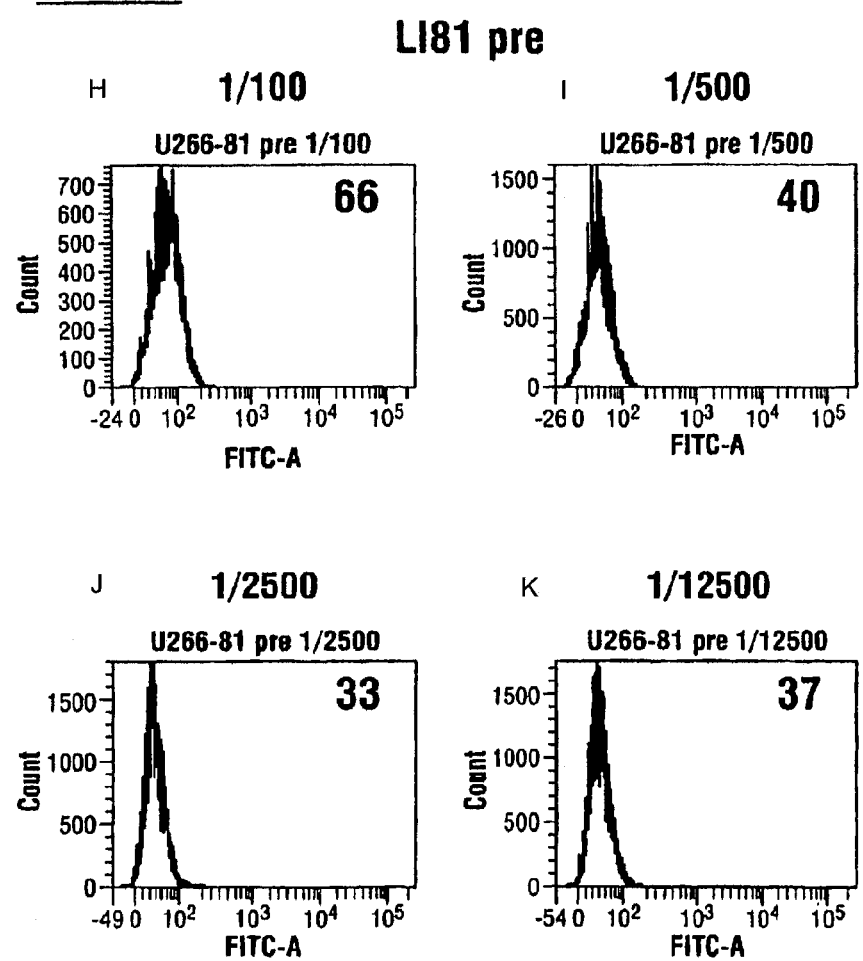
Fig. 2<sup>B</sup>
*U266B1*

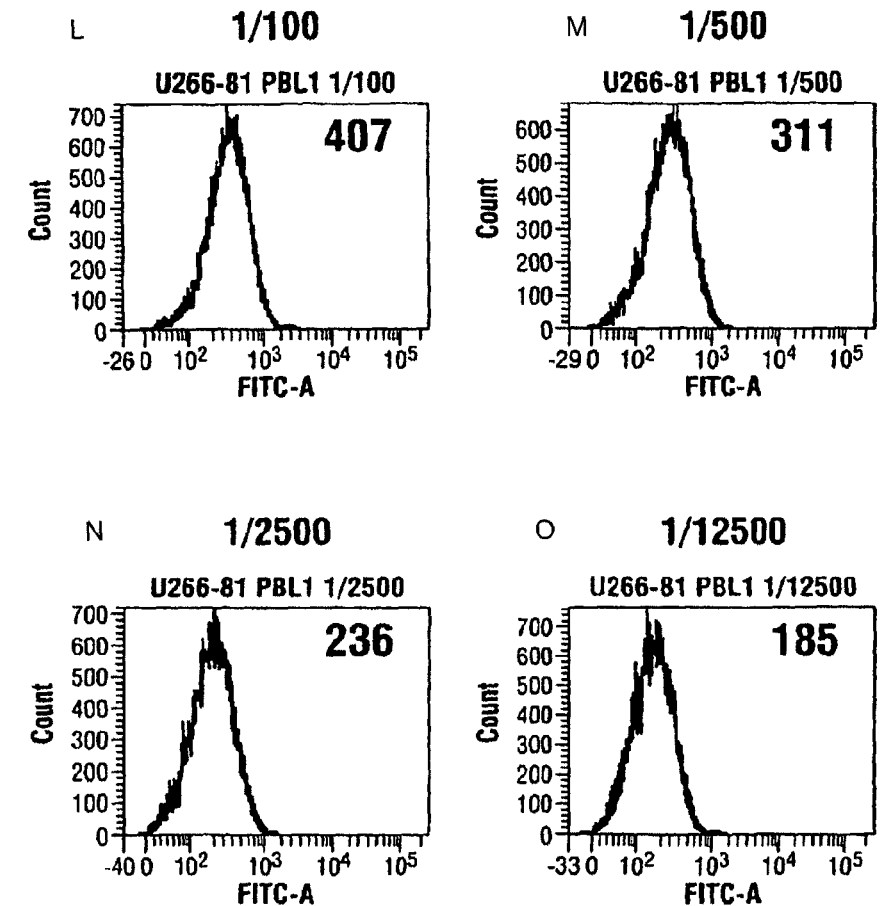

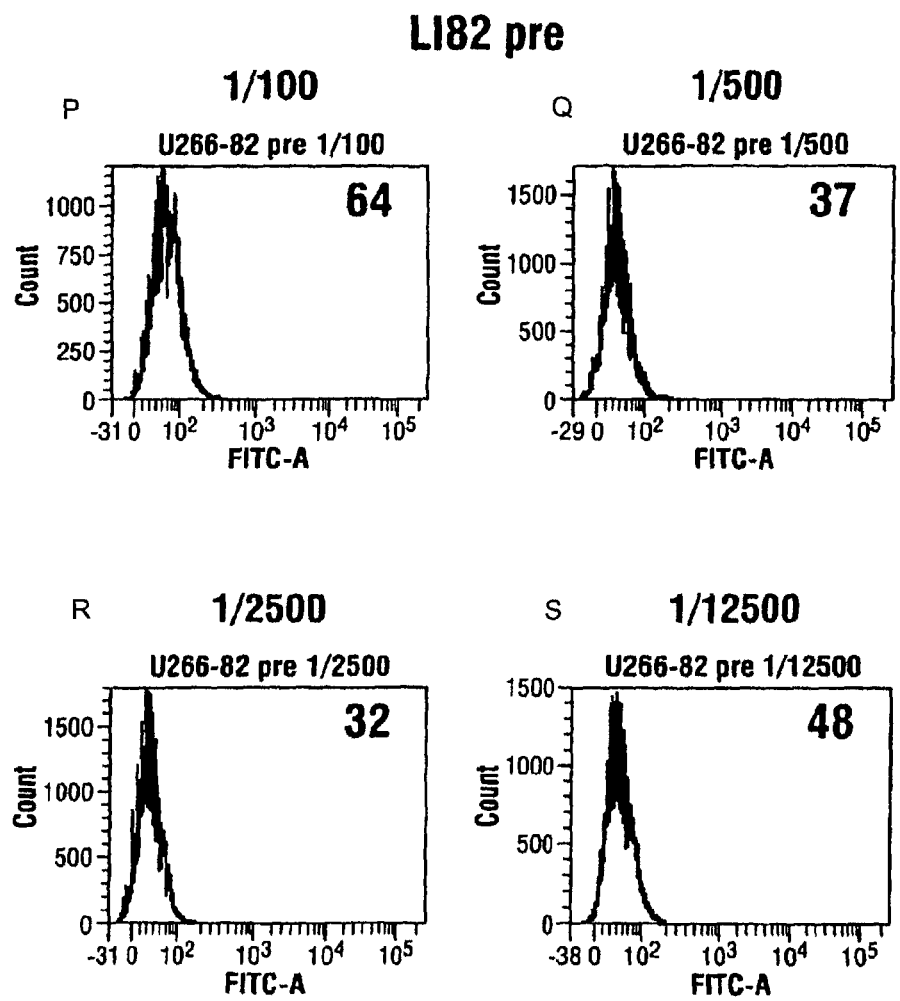

Fig. 2 E
*U266B1*
LI82 PBL2
T      1/100          U      1/500
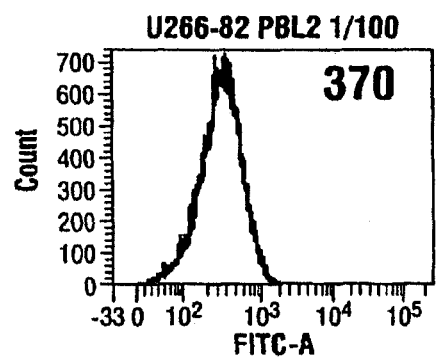 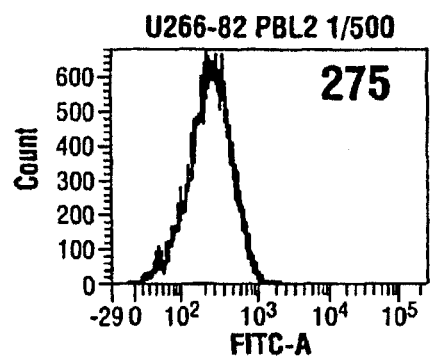
V      1/2500          W      1/12500
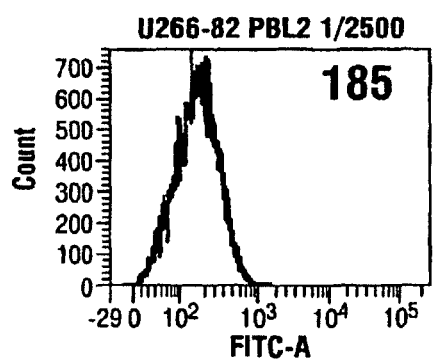 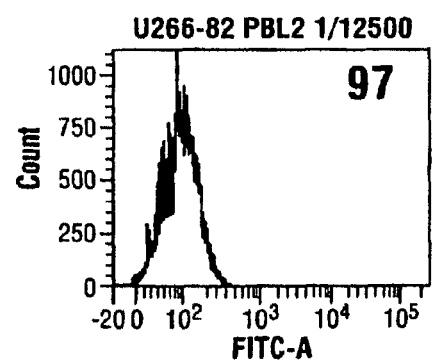

Fig. 5A

```
          SEQ ID NO:
PMP32H5    408   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP31C8    412   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW------RYSDYDLPLPPPG--DYWGQGTQVTVSS
PMP32S10   439   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW------RYSDYDLPLPPPG--DYWGQGTQVTVSS
PMP28A2    426   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP28H4    423   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP26B6    421   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP31B11   415   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP41F4    410   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP28F7    422   EVQLVESGGGLVQPGGSLRLSCAASGFTFGSYDMSWVRQAPGKGPEWVSAINSGGG--STYYADSVKGRFTISRDNAKNTLYLQMNSLKPEDTAVYYCATDW-----RYSDYDLPLPPPG--DYWGQGTQVTVSS
PMP28C7    424   EVQLVESGGGLVQPGGSLRLSCAASGFTFGSYDMSWVRQAPGKGPEWVSAINSGGD--NTYYADSVKGRFTISRDNAKNTLYLQMNSLKPEDTAVYYCATDW-----RYSDYDLPLPPPG--DYWGQGTQVTVSS

PMP33C10   406   EVQLVESGGGLVQPGGSLRLSCAASGFTFDDYGMSWVRQAPGKGLEWVSAISWNGG--STYYYESMKGRFTISRDNAKNTVYLQMNSLKPEDTAVYYCVKGSTAIVGVPPTY-----PCEY-DYWGQGTQVTVSS
PMP30A10   420   EVQLVESGGGLVQPGGSLRLSCAASGFTFDDYGMSWVRQAPGKGLEWVSAISWNGG--STYYYESMKGRFTISRDNAKNTVYLQMNSLKPEDTAVYYCVKGSTAIVGVPPTY-----PCEY-DYWGQGTQVTVSS
PMP35H4    429   EVQLVESGGGLVQPGGSLRLSCAASGFTFDDYGMSWVRQAPGRATEWVSAISWNGG--NTYYYESMKGRFTISRDNAKNIVYLQMNSLKPEDTAVYYCVKGSTAIVGVPPTY-----PDEY-DYWGQGTQVTVSS

PMP40C9    399   EVQLVESGGGLVQPGGSLRLSCAASGFSLDYYAIGWFRQAPGKEREGVSCMDSSAGTTSTYYSDSVKGRFTISRDDAKNTVLQMNSLKPEDTAVYYCAADGHLNNGQRYVPCSQISWRGWNDYWGQGTQVTVSS
PMP40H5    427   EVQLVESGGGLVQPGGSLRLSCAASGFSLDYYAIGWFRQAPGKEREGVSCMDSSGGTTSTYYSDSVKGRFTISRDDAKNTVLQMNSLKPEDTAVYYCAADGHLNNGQRYVPCSQISWRGWNDYWGQGTQVTVSS
PMP33A2    407   EVQLVESGGGLVQPGGSLRLSCAASGFSLDYYAIGWFRQAPGKEREGVSCMDSSGGTTSTYYSDSVKGRFTISRDDAKNTVLQMNSLKPEDTAVYYCAADGHLNNGQRYVPCSQISWRGWNDYWGQGTQVTVSS
PMP34F8    400   EVQLVESGGGLVQPGGSLRLSCAASGFSLDYYAIGWFRQAPGKEREGVSCMDSSDGTTNTYYSDSVKGRFTISRDDAKNTVLQMNSLKPEDIAS CYCAADGHLNNGQPYVPCSQISWRGWNDYWGQGTQVTVSS
PMP35B4    640   EVQLVESGGGLVQPGGSLRLSCAASGFSLDYYAIGWFRQAPGKEREGVSCMDSSDGTTRTYYSDSVKGRFTISRDDAKNTVYLQMNSLKPEDTAVYYCAADGHLNNGRYVPCSQISWRGWNDYWGQGTQVTVSS

PMP34A5    404   EVQLVESGGGLVQPGGSLRLSCAASGFTLGYFAIGWFRQAPGKEREGVSCISSSDG--STYYADSVKGRFTVSRDNAKNTVYLQMNSLKPEDTAVYYCATD------RSVYYCSGGAPEEY--YWGQGTQVTVSS
PMP33G3    405   EVQLVESGGGLVQPGGSLRLSCAASGFTLGYFAIGWFRQAPGKEREGVSCISSGDG--SAYYADSVKGRFTVSRDNAKNTVYLQMNSLKPEDTAVYYCATD------RSVYYCSGGAPEEY--YWGQGTQVTVSS
PMP34S9    401   EVQLVESGGGLVQPGGSLRLSCAASGFTLDYYAIGWFRQAPGKEREGVCISSSDG--STYYADSVKGRFTISRDNAKNTVYLQMNSLKPEDTARYYCATD-------RSVYYCSGDAPEEY---YWGQGTQVTVSS
PMP34D2    402   EVQLVESGGGLVQPGGSLRLSCAASGFTLDYFAIGWFRQAPGKERERVSCISSSDG--STYYADSVKGRFTISRDNAKNTVYLQMNSLKPEDTAVYYCATD--------RSVYYCSGGAPEEY--YWGQGTQVTVSS
PMP35F10   641   EVQLVESGGGLVQPGGSLRLSCAASGFTLDYFAIGWWKRQAPGKGREGVSCISSGDG--STNYADSVKGRFTISRDNAKNTVYLQMNSLKPEDTAVYYCATD-------RSVYYCSGGAPEEY--YWGQGTQVTVSS
PMP35B7    642   EVQLVESGGGWVQPGGSLRLSCAASGFTLDYFAIGWKRQAPGKGREGVSCISSGDG--STNYADSVKGRFTISRDNAKNTVYLQMNSLKPEDTAVYYCATD-------RSVYYCSGGAPEEY--YWGQGTQVTVSS
```

Fig. 5 B

```
          SEQ ID NO:
PMP35H7   419  EVQLVESGGGLVQPGGSLRLSCAASGFTLDYYVIGWFRQAPGKEREGVSCISSSDD--STYYADSVKGRFTISRDNAKNTVYLQMNSLKPEDTAVYYCAAD----LLRTPEFCTDSAP--Y-DYWGQGTQVTVSS
PMP30A2   419  EVQLVESGGGLVQPGGSLRLSCAASGFTLDYYVIGWFRQAPGKEREGVSCISSSDD--STYYADSVKGRFTISRDNAKNTVYLQMNSLKPEDTAVYYCAAD----LLRTPEFCTDSAP--Y-DYWGQGTQVTVSG
PMP34C3   463  EVQLVESGGGLVQPGGSLRLSCVASGFSLDYYVIGWFRQAPGKEREGVSCISSSDG--STYYADSVKGRFTISRDNAKNTVYLQMNSLKPEDTAVYYCAAD----LLRTPEFCVDSAP--Y-DYWGRGTQVTVSS
PMP30G11  418  EVQLVESGGGLVQPGGSLRLSCVASGFSLDYYVIGWFRQAPGKEREGVSCISSSDG--STYYADSVKGRFTISRDNAKNTVYLQMNSLKPEDTAVYYCAAD----LLRTPEFCVDSAP--Y-DYWGQGTQVTVSS
PMP34A12  436  EVQLVESGGGLVQPGGSLRLSCVASGFSLDYYVIGWFRQAPGKEREGVSCISSSDG--STYYADSVKGRFTISRDNAKNTVYLQMNSLKPEDTAVYYCAAD----LLRTPEFCVDSAP--Y-DYWGQGTQVTVSS
PMP30B6   417  EVQLVESGGGLVQPGGSLRLSCAASGFTLDYYVIGWFRQAPGKEREAVACISSSDR--STYYADSVKGRFTISRDNAKNTGYLQMNSLKPEDTAVYYCAAD----LLRTPEFCSDSAP--Y-DYWGQGTQVTVSS

PMP35E11  430  EVQLVESGGGLVQAGGSLRLSCAASGFTFDDYAIGWFRQAPGKEHEGVSCISSSDG--STYYADSVKGRFTISDNAKNTVYLQMNSLKPEDTAVYYCAAERDVPA-----RSLCGSYY-WYDYRGQGTQVTVSS
PMP35G11  643  EVQLVESGGGLVQAGGSLRLSCAASGFTFDDYAIGWFRQAPGKEREGVSCISSSDG--STYYADFVKGRFTISSDNAQNTVYLQMNSLKPEDTAVYYCAAQRDVPA-----RSLCGSYY-NYDYRGQGTQVTVSS

PMP32F10  409  EVQLVESGGGLVQAGGSLRLSCAASGFTFDDYAIGWFRQAPGKEREGISCISSSDG--STYYADSVKGRFTISSDNAKNTVYLQMNSLKPEDTAVYYCAAEPPDSS-----WILDGSPE-FFKFNGQGTQVTVSS
PMP31C5   413  EVQLVESGGGLVQAGGSLRLSCAASGFTFDDYAIGWFRQAPGKEREGVSCISSSDG--STYYADSVKGRFTISSDNAKNTVYLLMNSLKPEDTAVYYCAAEPPDSM-----WSLDGSPE-FFKFWGQGTQVTVSS
PMP31D2   411  EVQLVESGGGLVQAGGSLRLSCAASGFTFDDYAIGWFRQAPGKEREGVSGISSSDG--NTYYADSVRGRFTISSDNAKNTVYLQMNSLKPEDTAVYYCAAEPPDSN-----WYLDGSPE-FFKFWGQGTQVTVSS
PMP32C9   440  EVQLVESGGGLVQAGGSLRLSCAASGFTFDDYDIGWFRQAPGKEREGVSGISSSDG--NTYYADSVKGRFTISSDNAKNTVYLQMNSLKPEDTAVYYCAAEPPDSS-----WYLDGSPE-FFKYWGQGTQVTVSS

PMP30B1   644  EVQLVESGGGLVQAGGSLRLSCAASGGTFSSYDMCWYRQAPGKEREFVAFINWSGS--STYYADSVKGRFTISRDNAKNTVYLQMNSLKEDTAIYYCN--AQYG-----LGYA-E--------DYWGQGTQVTVSS
PMP35F4   429  EVQLVESGGGLVQAGGSLRLSCAASGRIFSSYDMCWYRQAPGKEREFVAIITWN-S--STYYADSVKGRFTISRDNAKNTVYLQMNSLKPEDTAIYYCN--AQYG-----LGYA-E--------DYWGQGTQVTVSS

PMP1A4    441  EVQLVESGGGLVQAGGSLRLSCAASGSIFKVWAMGWYRQAPGKEQRELVAGTI-SGG--STYYADSVKGRLTISRDNAKNTVYLQMNSLKPEDTAVYYCSFVTTNSDYDLG----R--------DYWGQGTQVTVSS
PMP35C10  431  EVQLVESGGGLVQAGGSLRLSCAASGRFSSYDMGWYRQAPGKEREFVAVIHWSSG--STYYADPVKGRFTISRDNAKNTVYLQMNSLKPEDTAIYYCN--AFLP----GPEGPH-------DYWGQGTQVTVSS
PMP34G9   432  EVQLVESGGGLVQAGGSLRLSCAASGRTFSSSYDMTWYRQVFGKEREFVAVISWGG--STYYADSVKGRFTISRDNAKNTVYLQMNSLKPEDTAIYYCN--AYTG----GGD---------DYWGQGTQVTVSS
PMP30C11  442  EVQLVESGGGLVQAGGSLRLSCAASGRTFSSYDMGWYRQAPGKEREFVAVISBSGS--STYYADSVKGRFTISRDNAKNTVYLQMNSLKPEDTAIYYCK--AEVV-----AG--DY------DYWGQGTQVTVSS
PMP28E11  645  EVQLVESGGGLVQPGGSLRLSCAASGFPLDYYAIGNFRQAPGKEREGVSCISSSDG--STYYADSVKGRFTISRDNAKNTVYLQMNSLKPEDTAVYYCALVHTTAGATG-----VPQREYEYEWWGQGTQVTVSS
PMP32E2   438  EVQLVESGGGLVQAGGSLRLSCAASGNIFDDNTMGWTWNRQPPGKQRELVAI1ATD--GSTNYADSVKGRFTISRDNAKNTVYLQMNSLKPEDTAVYYCNLFSLRLGRD--------------YWGQGTQVTVSS
PMP33A3   437  EVQLVESGGGLVQPGGSLRLSCAASGFTLDYGAIGWFRQAPGKEREGVSCISSSTG--STYYADSVKGRFTISRDNGKHTVYLQMNSLKPEDTAVYYCAARDKMWSPCLVAAH---EEALFEYDYWGQGTQVTVSS
```

Fig. 6

```
Inhibitors
            SEQ ID NO:
PMP40B5     427  EVQLVESGGGLVQPGGSLRLSCAASGFSLD  YYAIG    WFRQAPGKEREGVS  CMDSSSGTTSTYYSDSVKG  RFTISRODAKNTVYLQMNSLKPEDTAVYYCAA  DGHLNWGQRYVPCSQISWRGWNDY  WGQGTQVTVSS
PMP35E11    430  EVQLVESGGGLVQAGGSLRLSCAASGFTFD  DYAIG    WFRQAPGKEHEGVS  CISSSDGSTYYADSVKG    RFTISSDNAKNTVYLQMNSLKPEDTAVYYCAA  ERDVPARSLCGSYYWYDY        RGQGTQVTVSS
PMP32C9     440  EVQLVESGGGLVQAGGSLRLSCAASGFTFD  DYDIG    WFRQAPGKEREGVS  GISSSDGNTYYADSVKG    RFTISSDNAKNTVYLQMNSLKPEDTAVYYCAA  SPFDSSWYLDGSPEFFRY        WGQGTQVTVSS
PMP35H4     428  EVQLVESGGGLVQPGGSLRLSCAASGFTFD  DYGMS    WVRQADGBRATEWVS AISWNGKNTYYTESMKG    RFTISRDNAKNTVYLQMNSLKPEDTAVYYCVK  GSTAIVGVPPTYPDEYDY        WGQGTQVTVSS
PMP32E10    439  EVQLVESGGGLVQPGGSLRLSCAASGFTFG  SYDMS    WVRQAPGKSPEWVS  AINSGGSTYYADSVKG     RFTISRDNAKNILYLQMNSLKPEDTAVYYCAT  DWRYSDYDLPLPPPGDY         WGQGTQVTVSS
PMP30C11    442  EVQLVESGGGLVQAGGSLRLSCAASGRTFS  SYDMG    WYRQAPGKEREFVA  VISRSGSTYYADSVKG     RFTISRDNAKNTVYLQMNSLKPEDTAIYYCKA  EVVAGDYDY                 WGQGTQVTVSS
PMP35C10    431  EVQLVESGGGLVQAGGSLRLSCAASGRTFS  SYDMG    WYRQAPGKEREFVA  VIHWSEGGTYYADPVKG    RFTISRDNAKNTVYLQMNGLKPEDTAIYYCNA  FLPGPEGPHDY               WGQGTQVTVSS
PMP34G9     432  EVQLVESGGGLVQAGGSLRLSCAASGRISS  SYDMI    WYRQVPGKEREFVA  VISWSGGSTYYADSVKG    RFTISRDNAKNTVYLQMNSLKPEDTAIYYCNA  YTGGGDDY                  WGQGTQVTVSS
PMP31A4     441  EVQLVESGGGLVQAGGSLRLSCAASGSIFK  VNAMG    WYRQAPGKQRELVA  GIISDGSTNYADSVKG     RMTISRDNAKNTVYLQMNSLKPEDTAVYYCSP  VTTNSDYDLGRDY             WGQGTQVTVSS
PMP32E2     438  EVQLVESGGGLVQAGGSLRLSCAASGNIFD  DNIMGWT  WNRQPPGKQRELVA  IIATDGSTNYADSVKG     RFTISRDNAKNTVYLQMNSLKPEDTAVYYCNL  FSLRLGRDY                 WGQGTQVTVSS
PMP33A3     437  EVQLVESGGGLVQPGGSLRLSCAASGFTLD  YGAIG    WFRQAPGKEREGVS  CISSSTGSTYYADSVKG    RFTISRDNGKNTVYLQMNSLKPEDTAVYYCAA  DMMRSPCLVAANEERLFEYDY     NGQGTQVTVSS
PMP34A12    436  EVQLVESGGGLVQPGGSIRLSCVASGFSLD  YYVIG    WFRQAPGKEREGVS  CISSSDGSTYYADSVKG    RFTISRDNAKNTVYLQMNSLKPEDTAVYYCAA  DLLRTFPFCVDSAPYDY         NGQGTQVTVSS
PMP28E11    645  EVQLVESGGGLVQPGGSLRLSCAASGFFLD  YYAIG    WFRQAPGKEREGVS  CISSSDGSTYYADSVKG    RFTISRDNAKNTVYLQMNSLKPEDTAVYYCAL  VHTTAQATGVPQREYEYEW       WGQGTQVTVSS
PMP35F4     629  EVQLVESGGGLVQAGGSLRLSCAASGRTFS  SYDMG    WYRQAPGKEREFVA  ITTWNSSTYYADSVKG     RFTISRDNAKNTVYLQMNSLKPEDTAIYYCNA  QYGLGYAEDY                WGQGTQVTVSS Non-inhibitors
            SEQ ID NO:
IL6R.c11    646  EVQLVESGGGLVQAGGSLRLSCAASGLIDD  DFAIG    WFRQAPGKEPEGVS  CIGSSDGSTYYADSVKG    RFTISRDNAKNTVYLQMNSLKPEDTAVYFCTA  LFDRCGSTWYYGMDY           WGKGTQVTVSS
IL6R.c13    447  EVQLVESGGGLVQPGGSLRLSCAASGFTLD  SYAIG    WFRQAPGKEDEGVS  CIGTSDGSTYYADSVKG    RFTISRDNAKNTVYLQMNSLKPEDTAVYYCTA  DGGPHAPLTVQDMCVMAIADY     WGQGTQVTVSS
IL6R.c15    647  EVQLVESGGGLVQAGGSLRLSCAASGRTFS  GADAG    WNRQTPGKEREFVA  AINWSGNSTYYADSVKG    RFTVSRDNAKNTVYLQMNSLKPEDTAVYYCHA  FRDDYYS                   EGKGTQVTVSS
```

Fig. 7 A
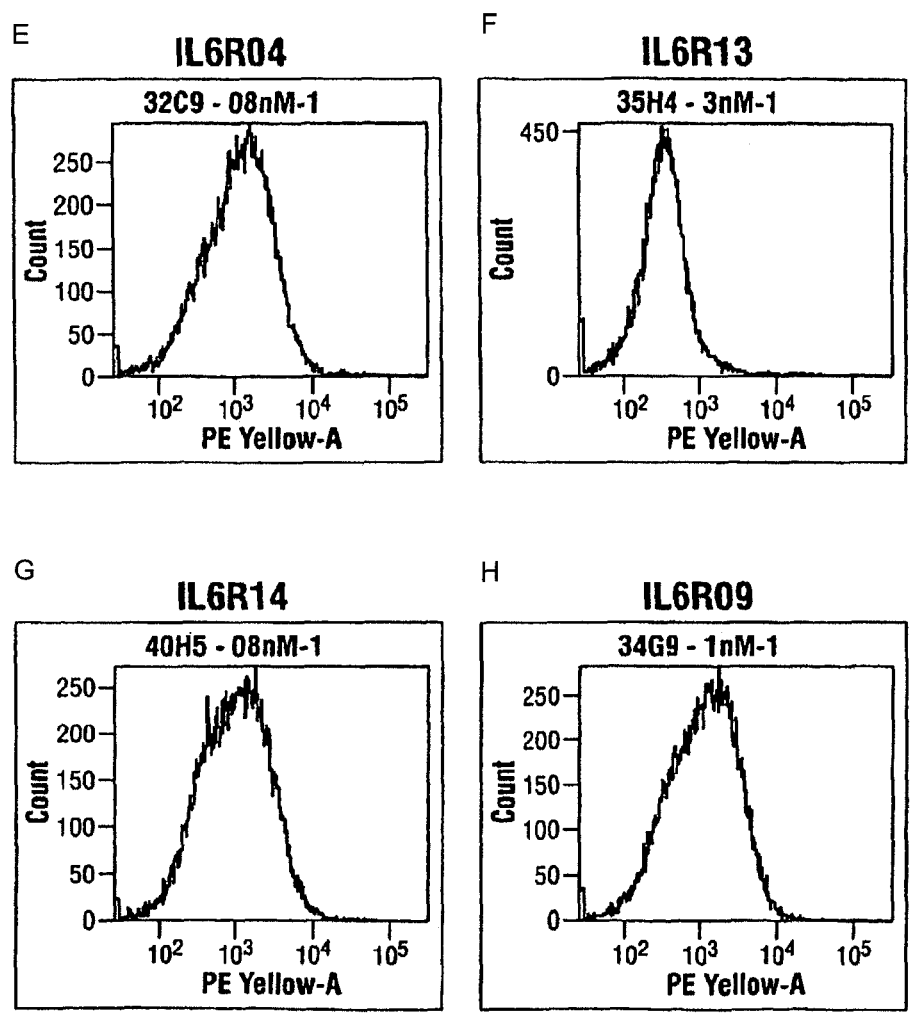

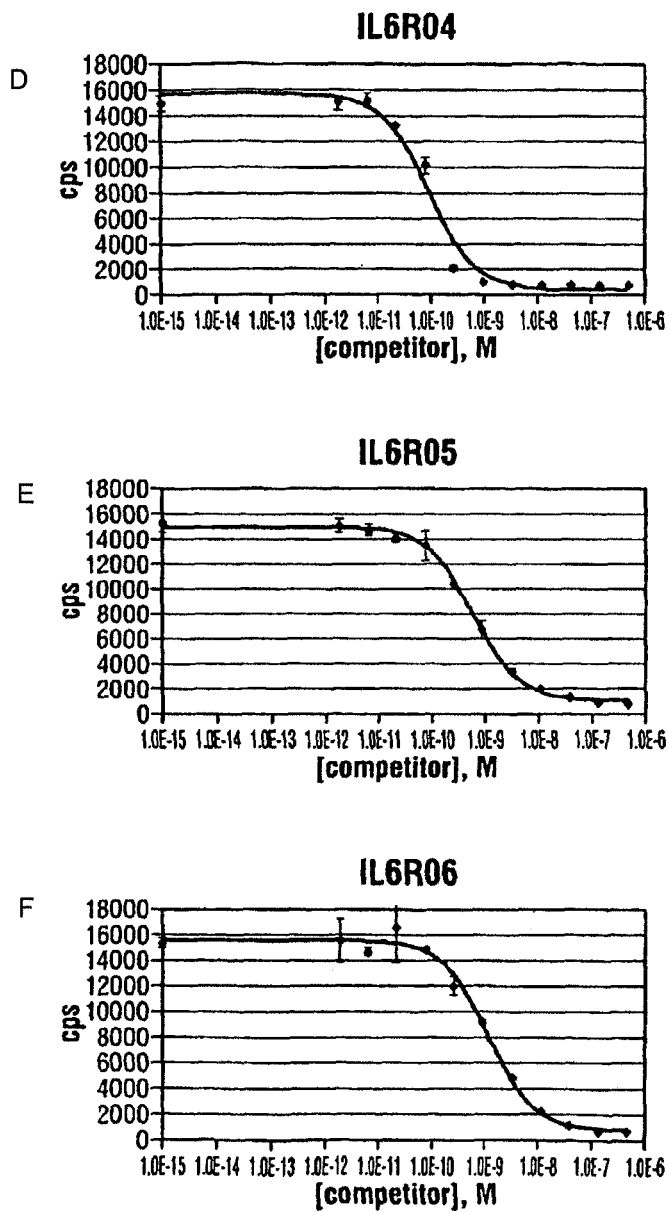

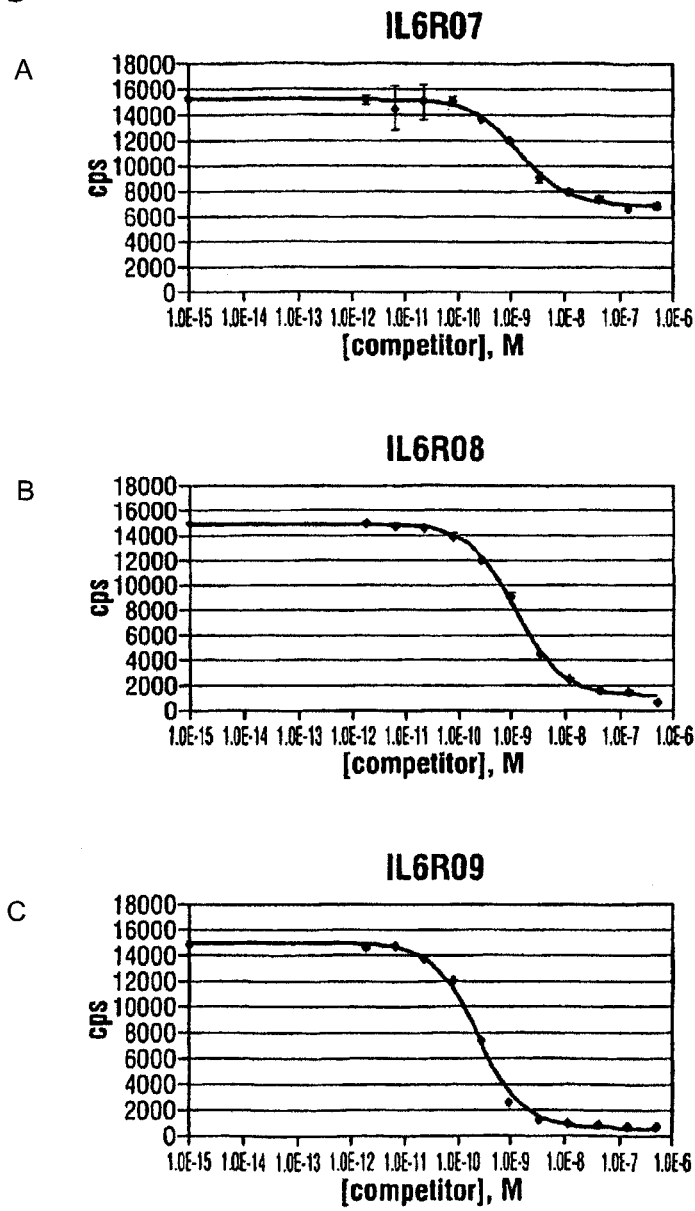

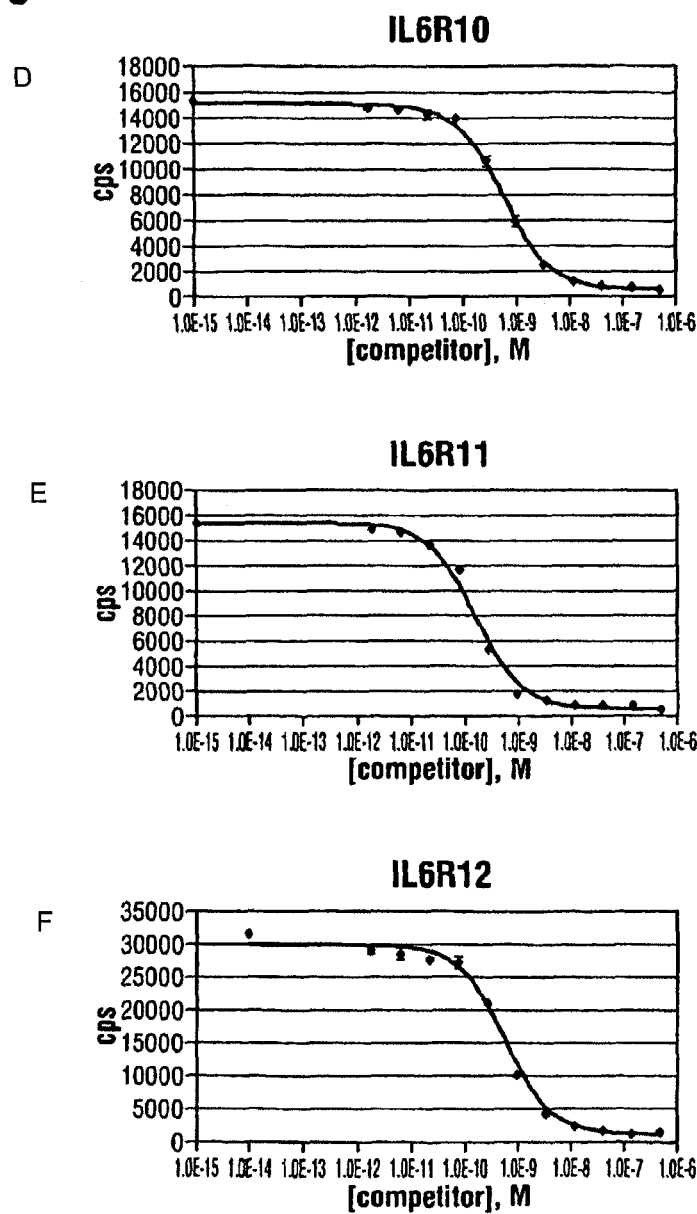

Fig. 10 A
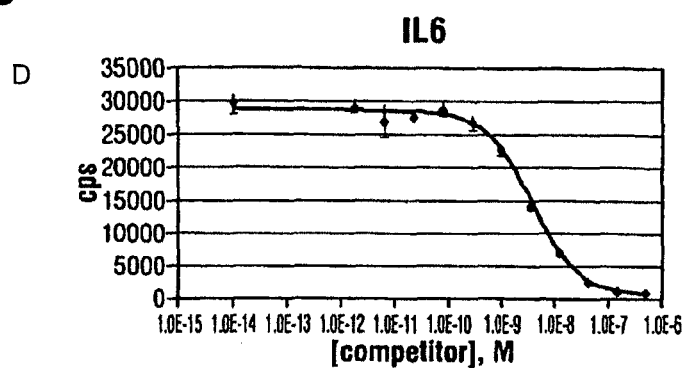
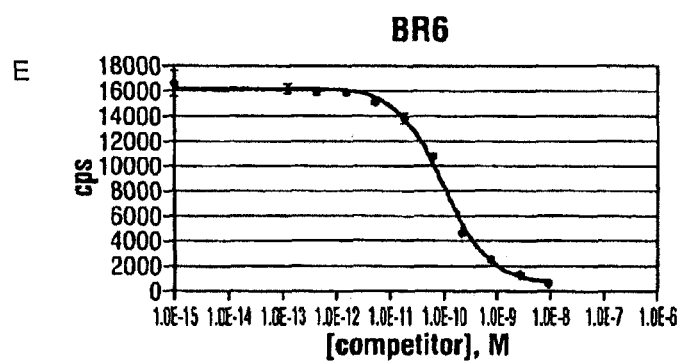

Fig. 11A
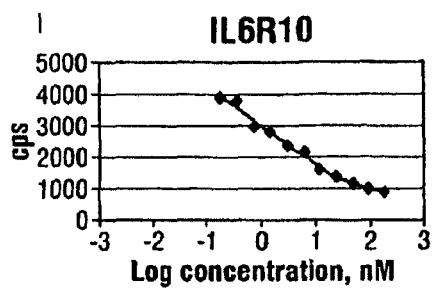
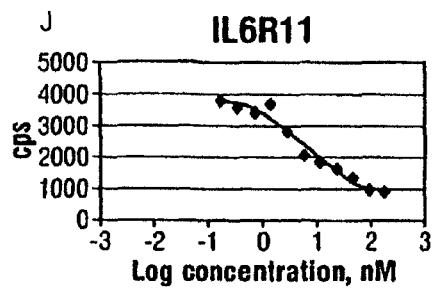
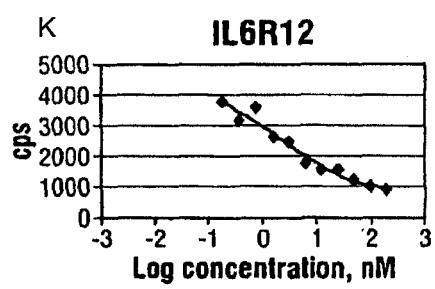
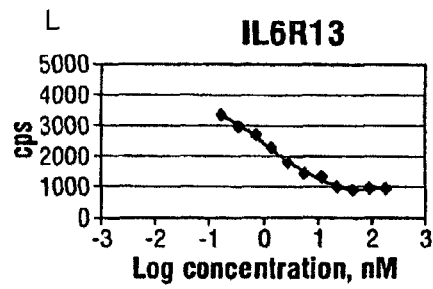
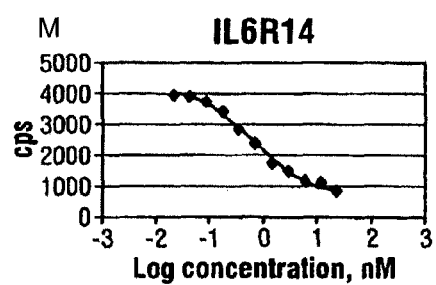
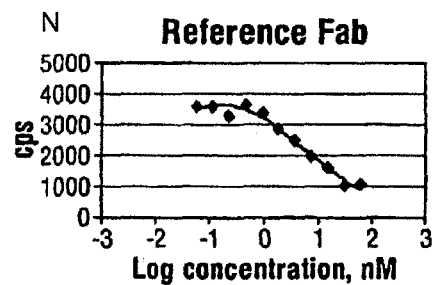
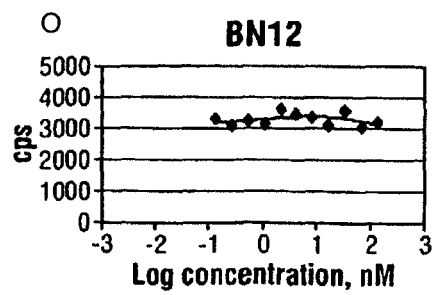
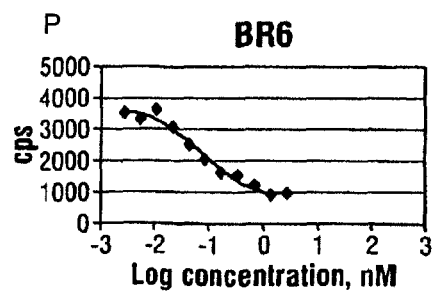

*Without human plasma*

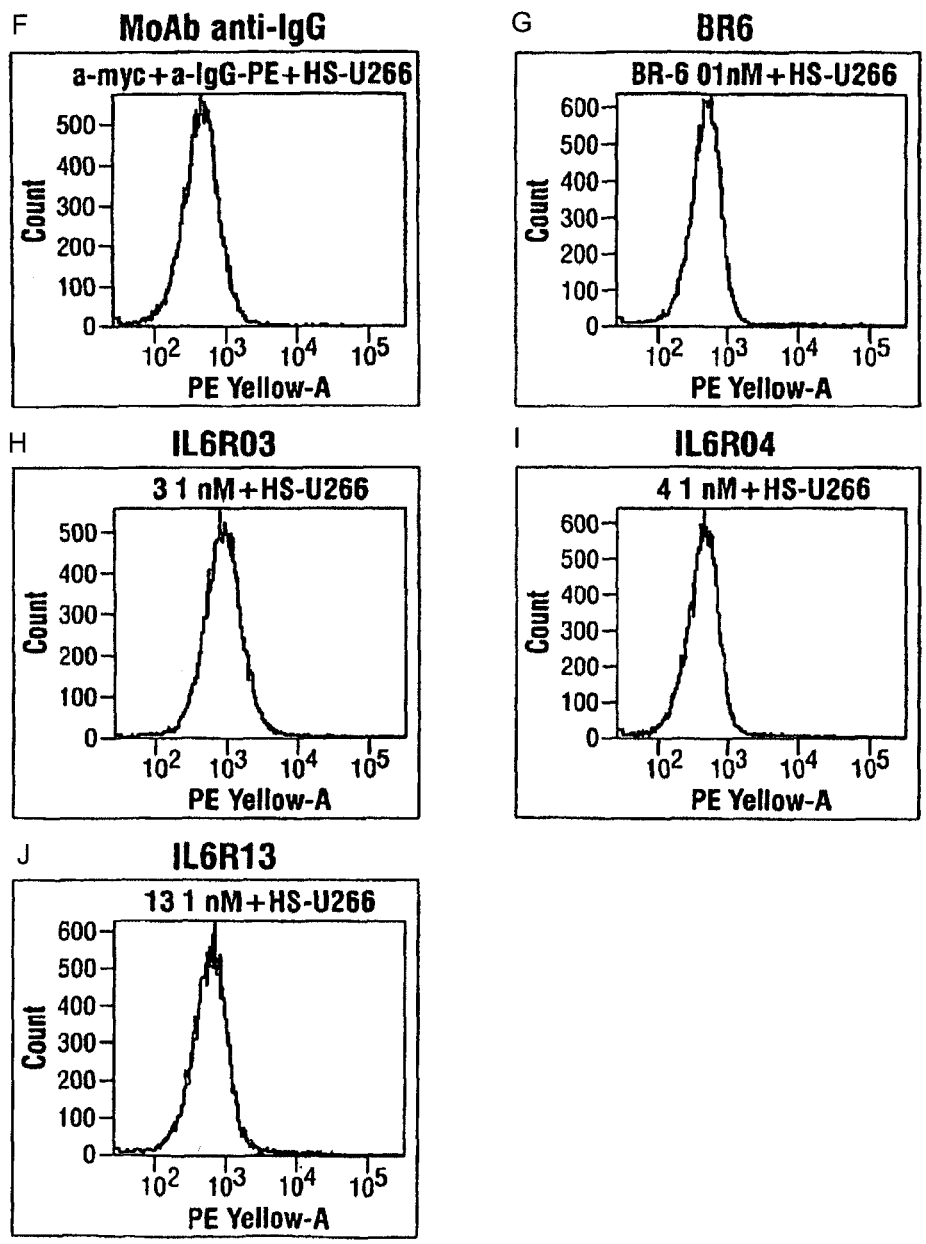

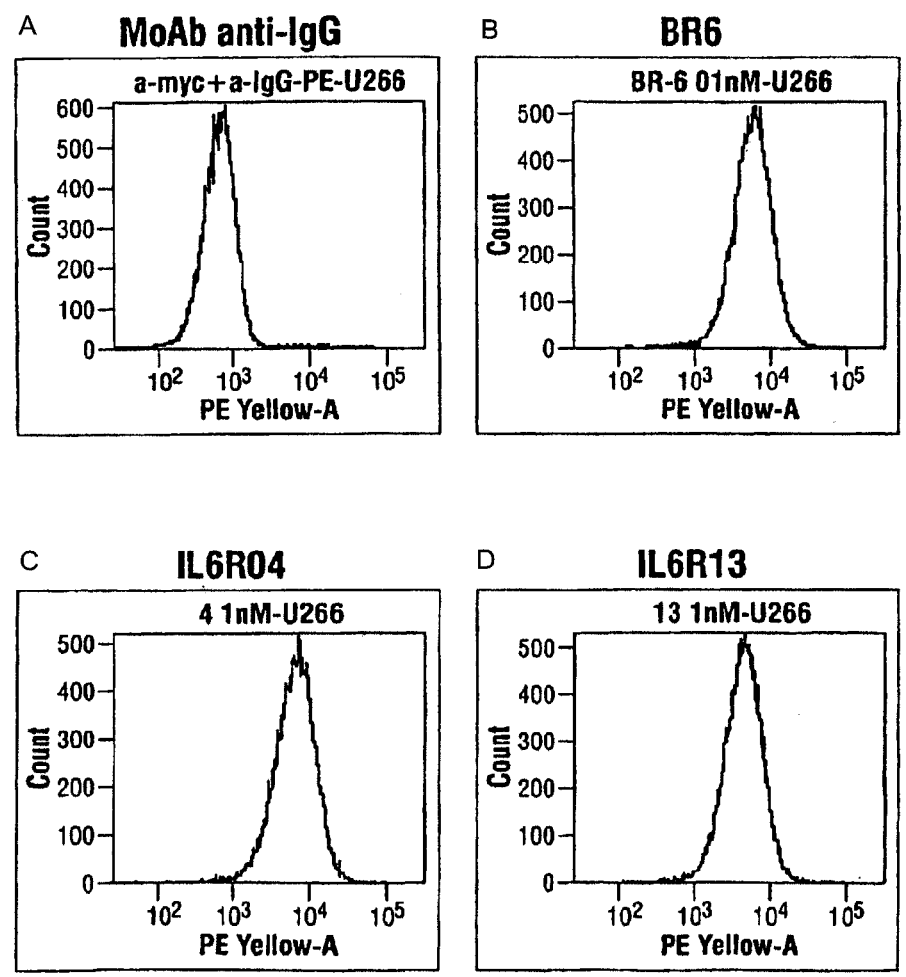

Fig. 13 A
*In the presence of cynomolgus plasma*
E MoAb anti-IgG
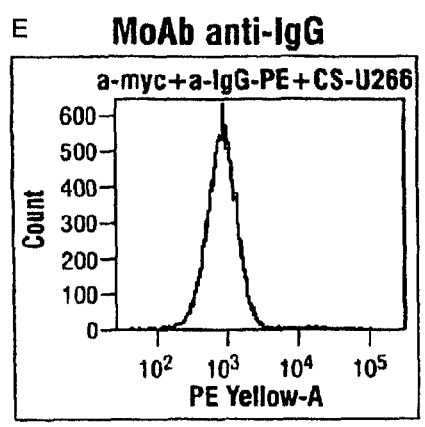
F BR6
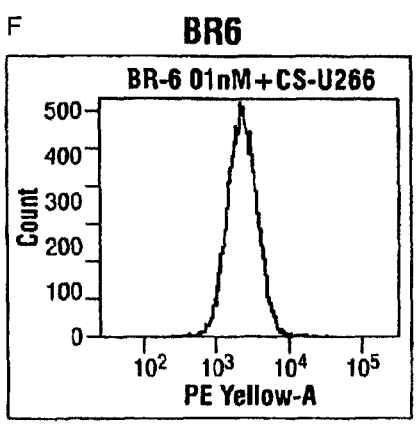
G IL6R04
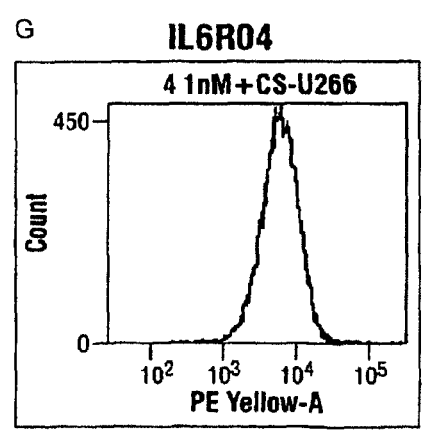
H IL6R13
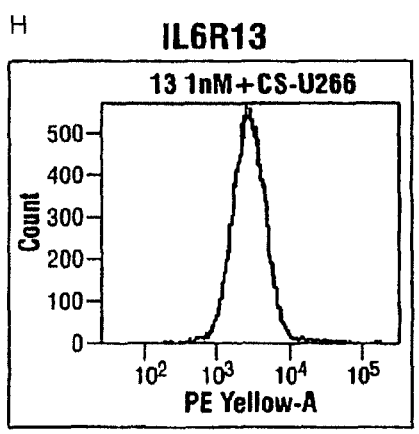

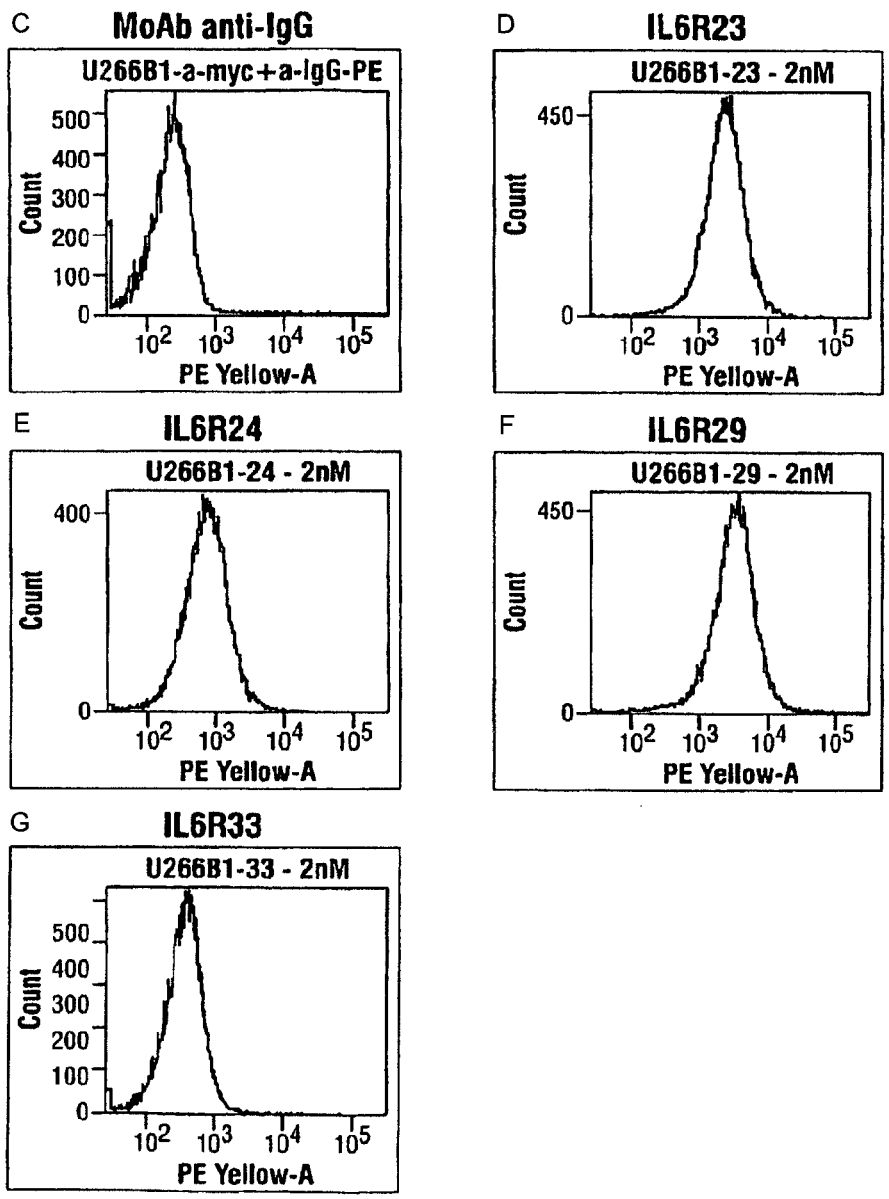

Fig. 16 A
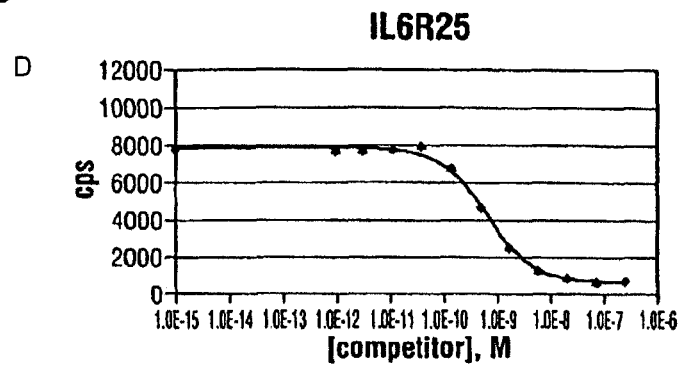
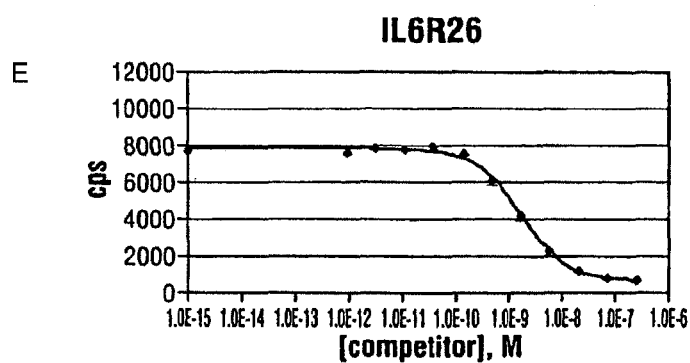
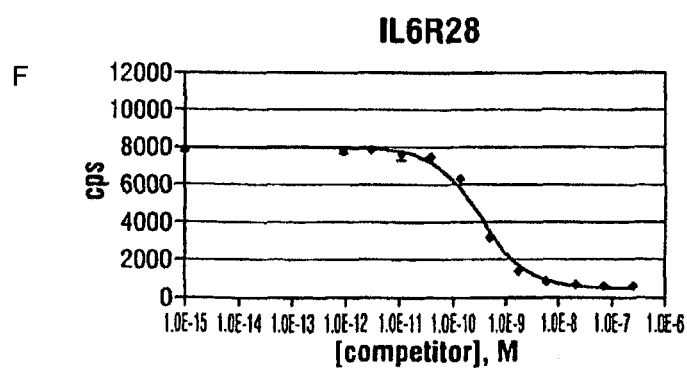

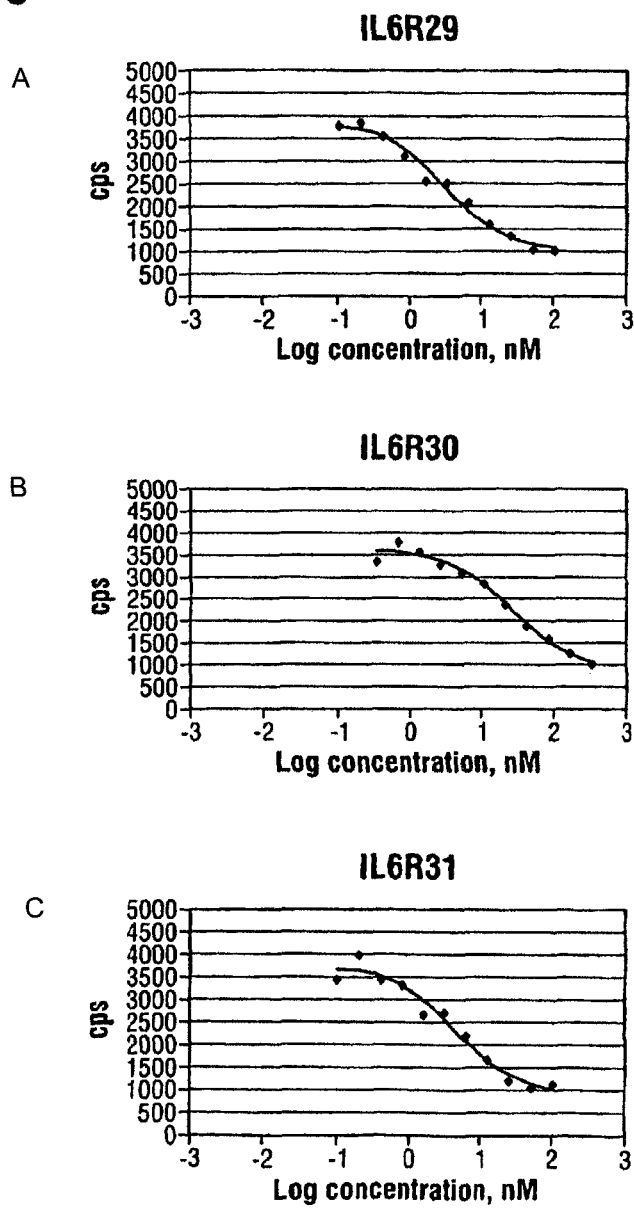

Fig. 19A
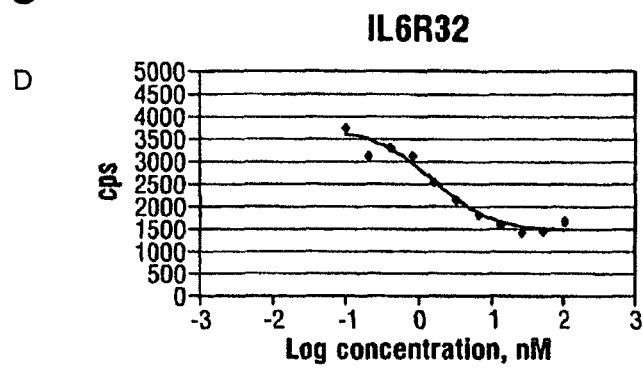
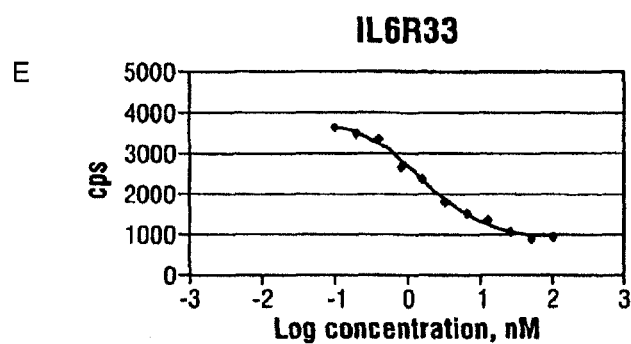
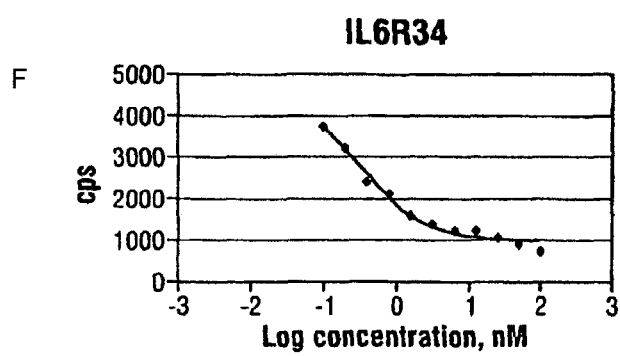

Fig. 21
A
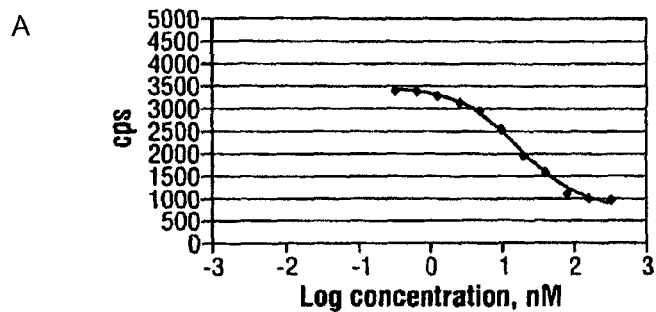
B
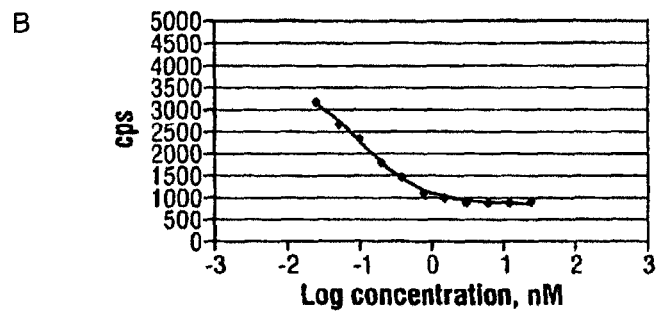
C
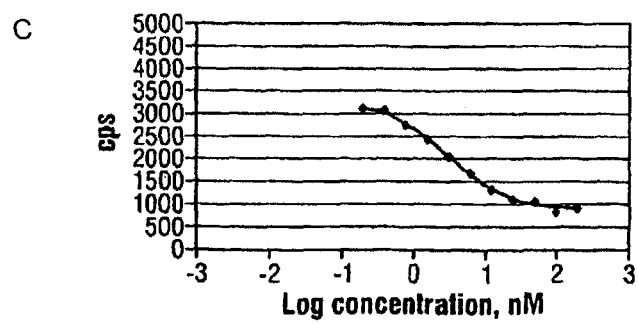

Fig. 21A
D
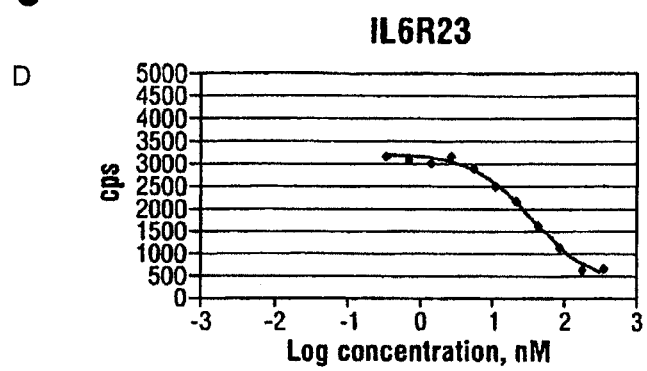
E
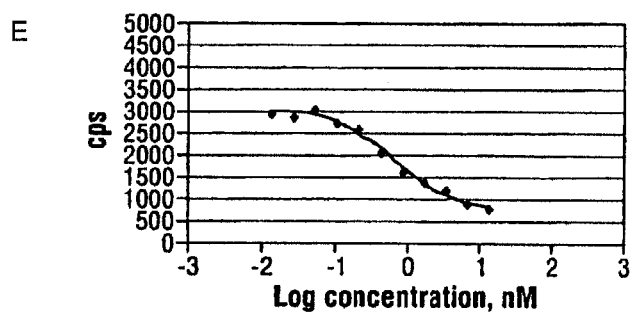
F
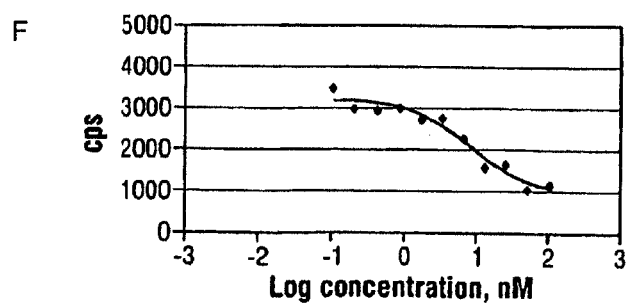

```
SEQ ID NO:    IL6R04
614    IL6R71  32C9hum1   EVQLVESGGGLVQPGGSLRLSCAASGFTFDDYDIGWFRQAPGKEREGVSGISSSDGNTYYADSVKGRFTISSDNAKNTVYLQMNSLRPEDTAVYYCAAEPPDGSWYLDGSPEFFKYWGQGTLVTVSS
615    IL6R72  32C9hum2   EVQLVESGGGLVQPGGSLRLSCAASGFTFSDYDIGWFRQAPGKEREGVSGISSSDGNTYYADSVKGRFTISSDNAKNTVYLQMNSLRPEDTAVYYCAAEPPDSSWYLDGSPEFFKYWGQGTLVTVSS
616    IL6R73  32C9hum3   EVQLVESGGGLVQPGGSLRLSCAASGFTFDDYDIGWFRQAPGKEREGVSGISSSDGNTYYADSVKGRFTISSDNAKNTVYLQMNSLRPEDTAVYYCAAEPPDSSWYLDGSPEFFKYWGQGTLVTVSS
617    IL6R74  32C9hum4   EVQLVESGGGLVQPGGSLRLSCAASGFTFDDYDIGWFRQAPGKEREGVSGISSSDGNTYYADSVKGRFTISSDNAKNTVYLQMNSLRPEDTAVYYCAAEPPDSSWYLDGSPEFFKYWGQGTLVTVSS
648    IL6R75  32C9hum5   EVQLVESGGGLVQPGGSLRLSCAASGFTFSDYDIGWFRQAPGKEREGVSGISSSDGNTYYADSVKGRFTISRDNAKNTLYLQMNSLRPEDTAVYYCAAEPPDSSWYLDGSPEFFKYWGQGTLVTVSS
                                                                                                                                          AAAEQKLISE IL6R13
619    IL6R81  35H4HUM1   EVQLVESGGGLVQPGGSLRLSCAASGFTFDDYGMSWVRQAPGRATEWVSAISWNGN--NTYYTESMKGRFTISRDNAKNTVYLQMNSLRPEDTAVYYCVKGSTAIVGVPPTYPDEYDYWGQGTLVTVSS
621    IL6R82  35H4HUM2   EVQLVESGGGLVQPGGSLRLSCAASGFTFDDYGMSWVRQAPGRATEWVSAISWNGN--NTYYTESMKGRFTISRDNAKNTLYLQMNSLRPEDTAVYYCVKGSTAIVGVPPTYPDEYDYWGQGTLVTVSS
620    IL6R83  35H4HUM3   EVQLVESGGGLVQPGGSLRLSCAASGFTFDDYGMSWVRQAPGKGLEWVSAISWNGN--NTYYTESMKGRFTISRDNAKNTVYLQMNSLRPEDTAVYYCVKGSTAIVGVPPTYPDEYDYWGQGTLVTVSS
622    IL6R84  35H4HUM3   EVQLVESGGGLVQPGGSLRLSCAASGFTFDDYGMSWVRQAPGKGLEWVSAISWNGN--NTYYTESMKGRFTISRDNAKNTLYLQMNSLRPEDTAVYYCVKGSTAIVGVPPTYPDEYDYWGQGTLVTVSS IL6R03
609    IL6R61  31A4hum1   EVQLVESGGGLVQPGGSLRLSCAASGSIFKVNAMGWYRQAPGKERELVAGIISGGSTNYADSVKGRLTISRDNAKNTVYLQMNSLRPEDTAVYYCSFVTTNSDYDLGRDYWGQGTLVTVSS
610    IL6R62  31A4hum2   EVQLVESGGGLVQPGGSLRLSCAASGFTFSVNAMGWYRQAPGKERELVAGTISGGSTNYADSVKGRFTISRDNAKNTVYLQMNSLRPEDTAVYYCSFVTTNSDYDLGRDYWGQGTLVTVSS
611    IL6R63  31A4hum3   EVQLVESGGGLVQPGGSLRLSCAASGSIFKVNAMGWYRQAPGKERELVAGIISGGSTNYADSVKGRLTISRDNAKNTLYLQMNSLRPEDTAVYYCSFVTTNSDYDLGRDYWGQGTLVTVSS612
       IL6R64  31A4hum4   EVQLVESGCCLVQPGGSLRLSCAASGSIFKVNAMGWYRQAPGKERELVAGIISGGSTNYADSVKGRLTISRDNAKNTVYLQMNSLRPEDTAVYYCAFVTTNSDYDLGRDYWGQGTLVTVSS
649    IL6R65  31A4hum5   EVQLVESGGGLVQPGGSLRLSCAASGSIFKVNAMGWYRQAPGKERELVAGIISGGSTNYADSVKGRFTISRDNAKNTLYLQMNSLRPEDTAVYYCAPVTTNSDYDLGRDYWGQGTLVTVSSAAAEQK
                                                                                                                                          LISEEDLNGAAHHHHHH**

IL6R13
625    IL6R85  35H4HUM5   EVQLVESGGGLVQPGGSLRLSCAASGFTFDDYGMSWVRQAPGQATEWVSAISWNGNNTYYTESMKGRFTISRDNAKNTLYLQMNSLRPEDTAVYYCVKGSTAIVGVPPTYPDEYDYWGQGTLVTVSS
627    IL6R86  35H4HUM6   EVQLVESGGGLVQPGGSLRLSCAASGFTFDDYGMSWVRQAPGRLTEWVSAISWNGNNTYYTESMKGRFTISRDNAKNTLYLQMNSLRPEDTAVYYCVKGSTAIVGVPPTYPDEYDYWGQGTLVTVSS
624    IL6R87  35H4HUM7   EVQLVESGGGLVQPGGSLRLSCAASGFTFDDYGMSWVRQAPGALEWVSAISWNGNNTYYTESMKGRFTISRDNAKNTLYLQMNSLRPEDTAVYYCVKGSTAIVGVPPTYPDEYDYWGQGTLVTVSS
626    IL6R88  35H4HUM8   EVQLVESGGGLVQPGGSLRLSCAASGFTEDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSS
623    IL6R89  35H4HUM9   EVQLVESGGGLVQPGGSLRLSCAASGFTFDDYGMSWVRQAPGRGLEWVSAISWNGNNYYTESMKGRFTISRDNAKNTLYLQMNSLRPEDTAVYYCVKGSTAIVGVPPTYPDEYDYWGQGTLVTVSS
628    IL6R90  35H4HUM10  EVQLVESGGGLVQPGGSLRLSCAASGFTFDDYGMSWVRQAPGQWLEWVSAISWNGNNYYTESMKGRFTISRDNAKNTLYLQMNSLRPEDTAVYYCVKGSTAIVGVPPTYPDEYDYWGQGTLVTVSS
```

IL-6R04 humanized clones in teh IL-6/IL-6R assay

| | IL-6R 71 | IL-6R 72 | IL-6R 73 | IL-6R 74 | IL-6R 04 |
|---|---|---|---|---|---|
| Sigmoidal dose-response | | | | | |
| Best-fit values | | | | | |
| BOTTOM | 2437 | 2456 | 2478 | 2030 | 1218 |
| TOP | 22034 | 22123 | 32032 | 20905 | 20499 |
| LOGEC50 | -9.816 | -9.795 | -10.04 | -9.878 | -9.744 |
| EC50 | 1.527e-010 | 1.605e-010 | 9.165e-011 | 1.325e-010 | 1.802e-010 |

|  | IL-6R 13 | IL-6R 81 | IL-6R 82 | IL-6R 83 | IL-6R 84 |
|---|---|---|---|---|---|
| Sigmoidal dose-response (variable slope) | | | | | |
| Best-fit values | | | | | |
| BOTTOM | 859.7 | 865.8 | 925.7 | 860.9 | 901.0 |
| TOP | 6888 | 7027 | 7080 | 6955 | 7303 |
| LOGEC50 | -10.19 | -10.13 | -9.322 | -10.11 | -9.332 |
| HILLSLOPE | -1.270 | -1.369 | -1.039 | -1.442 | -0.8822 |
| EC50 | 6.437e-011 | 7.466e-011 | 4.764e-010 | 7.789e-011 | 4.654e-010 |

|  | IL6R 03 | IL6R 65 | IL6R 04 | IL6R 75 | IL6R 13 | IL6R 88 |
|---|---|---|---|---|---|---|
| LOGEC50 | -9.980 | -9.833 | -10.25 | -10.36 | -10.30 | -10.14 |
| EC50 | 1.047e-010 | 1.047e-010 | 5.680e-011 | 4.320e-011 | 5.052e-011 | 7.273e-011 |

Stability test of IL6R13+humanised versions

Stability test of IL6R65 and IL6R75

| Temperature (°C) | IL6R03 (wt) | | IL6R65 (hum) | | IL6R04 (wt) | | IL6R75 (hum) | |
|---|---|---|---|---|---|---|---|---|
| | Y1 | Y2 | Y1 | Y2 | Y1 | Y2 | Y1 | Y2 |
| 4 | 102.510 | 97.490 | 100.160 | 99.840 | 100.310 | 99.690 | 100.410 | 99.590 |
| 37 | 102.510 | 103.350 | 100.470 | 101.100 | 102.460 | 101.540 | 99.310 | 99.030 |
| 50 | ~~142.680~~ | 103.770 | 102.350 | 101.720 | 102.150 | 101.540 | 99.030 | 100.410 |
| 70 | 97.490 | 92.470 | 73.240 | 73.870 | 103.380 | 99.380 | 100.410 | 101.800 |
| 90 | 96.650 | 97.070 | 62.910 | 63.220 | 105.540 | 104.620 | 103.730 | 101.800 |

Fig. 35
A
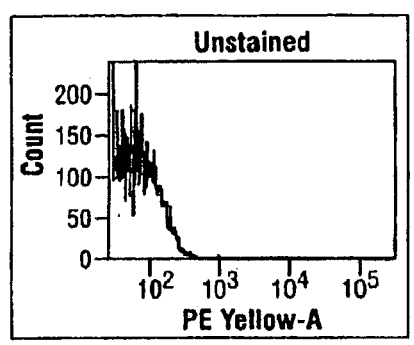
B
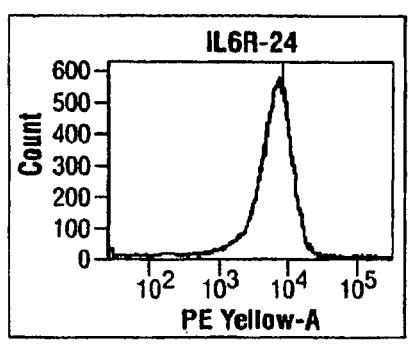
C
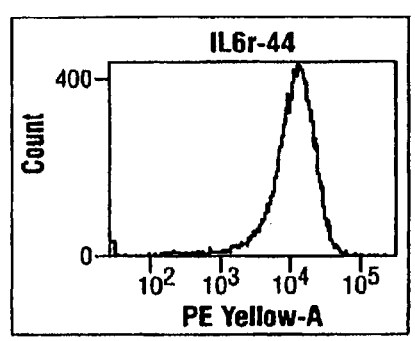
D
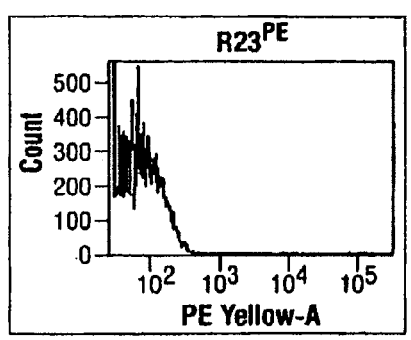
E
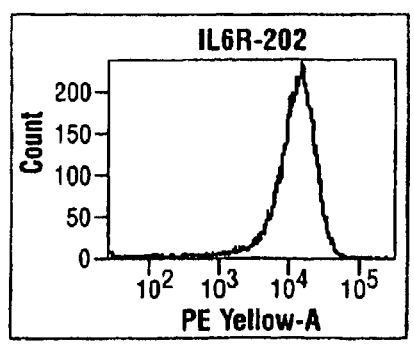
F
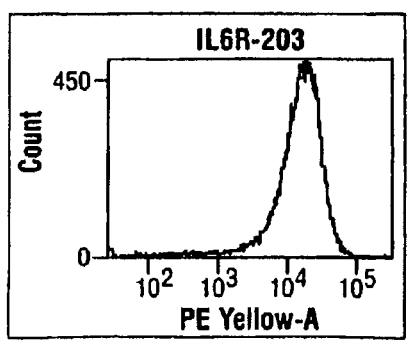

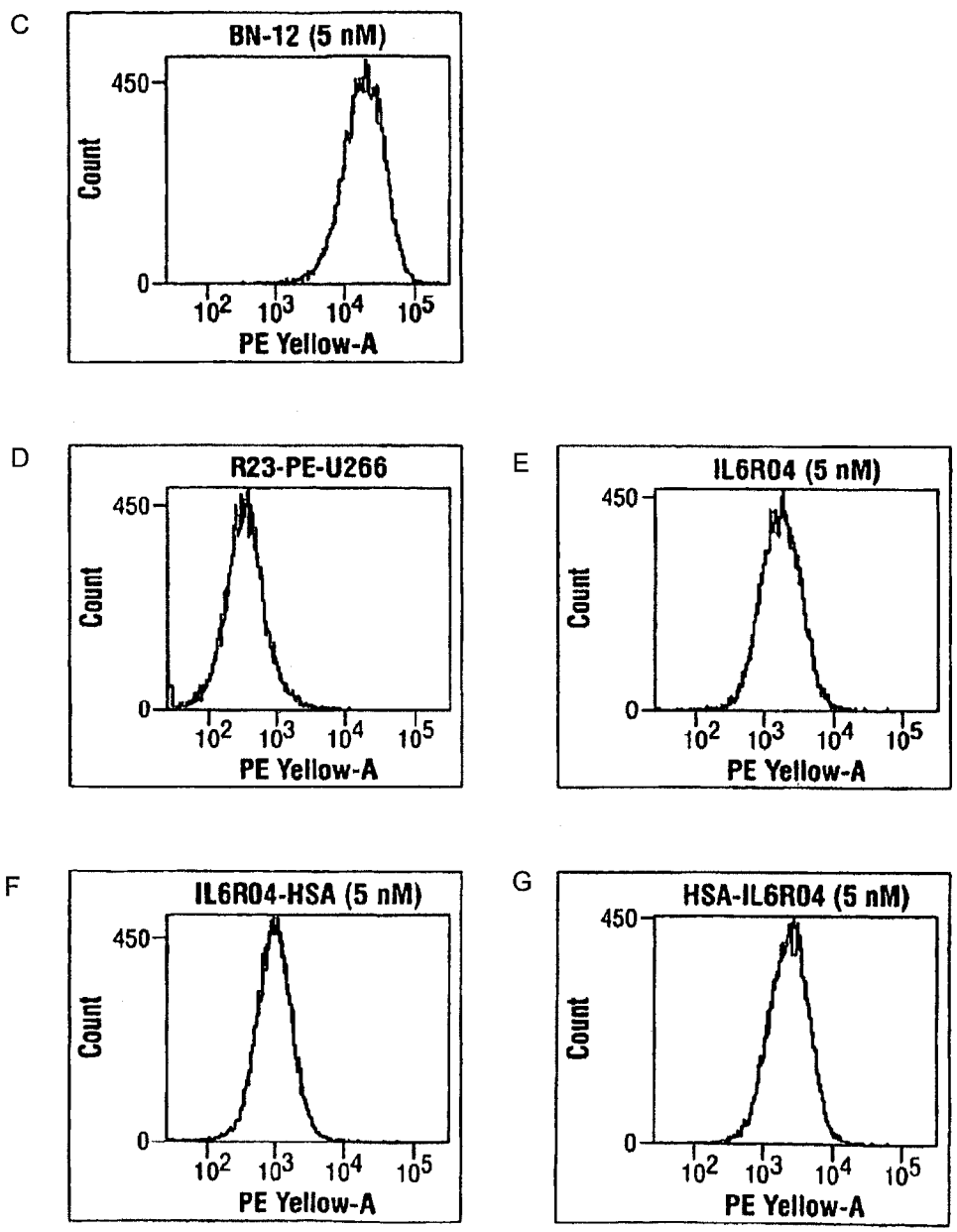

| time after administration [d] | Nanobody concentration [μg/ml] | | |
|---|---|---|---|
| | IL6R04-HSA-m1 | IL6R04-HSA-m2 | IL6R04-HSA-m3 |
| 0.01 | 230.361 ± 27.291 | 153.093 ± 9.864 | 267.718 ± 13.272 |
| 0.04 | 181.800 ± 22.200 | 116.827 ± 4.651 | 193.174 ± 37.839 |
| 0.08 | 138.344 ± 21.009 | 91.874 ± 7.251 | 200.765 ± 28.966 |
| 0.17 | 95.549 ± 10.658 | 103.977 ± 10.059 | 79.150 ± 14.135 |
| 0.33 | 107.148 ± 30.335 | 56.946 ± 8.855 | 120.554 ± 18.909 |
| 1.00 | 60.861 ± 29.498 | 35.076 ± 0.565 | 63.953 ± 21.415 |
| 2.00 | 22.024 ± 4.140 | 15.653 ± 0.897 | 23.096 ± 1.437 |
| 3.00 | 11.160 ± 0.235 | 7.889 ± 1.890 | 10.842 ± 0.901 |
| 5.00 | 6.283 ± 0.166 | 4.191 ± 0.501 | 5.957 ± 0.257 |
| 8.00 | 0.560 ± 0.008 | 0.371 ± 0.037 | 0.496 ± 0.037 |
| 14.00 | <0.02 | <0.02 | <0.02 |
| slope | -0.62 | -0.62 | -0.65 |
| $t_{1/2}$ | 1.11 | 1.12 | 1.07 days |

Fig. 50
A. XRPotency: B-N12 coat + human plasma + dilutions series of NB + 50 ng/mL IL-6 (2007-07-13-CORR)
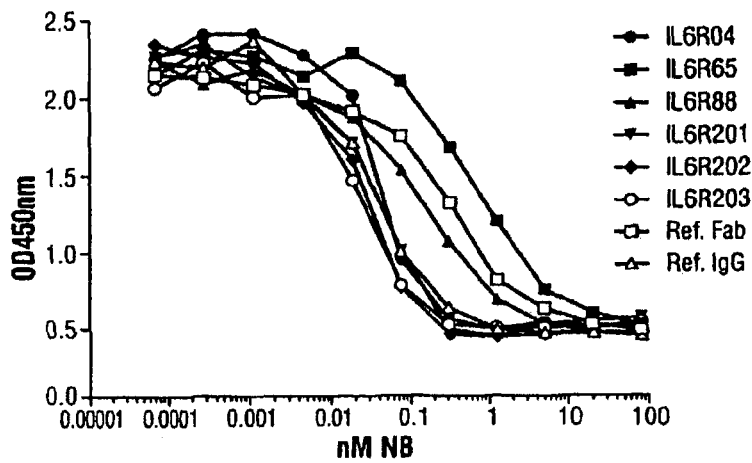
| | IL6R04 | IL6R65 | IL6R88 | IL6R201 | IL6R202 | IL6R203 | Ref. Fab | Ref. IgG |
|---|---|---|---|---|---|---|---|---|
| EC50 | 0.03938 | 0.7006 | 0.1433 | 0.03329 | 0.02441 | 0.02483 | 0.3024 | 0.03524 |
B. XRPotency: B-N12 coat + cyno plasma + dilutions series of NB + 50 ng/mL IL-6 (2007-07-13-CORR)
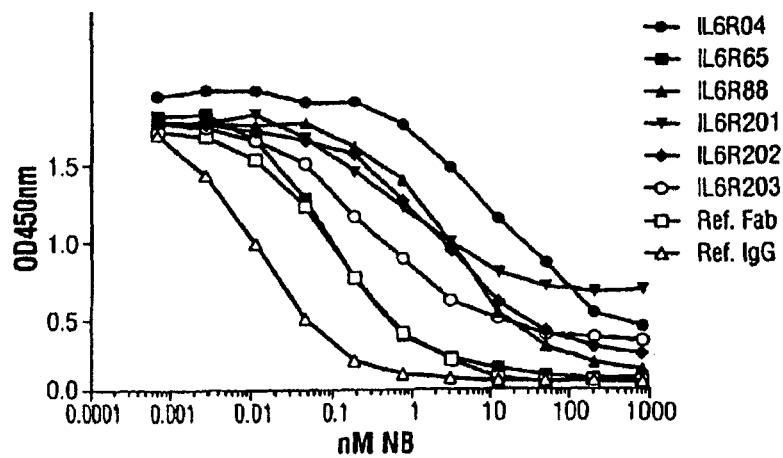
| | IL6R04 | IL6R65 | IL6R88 | IL6R201 | IL6R202 | IL6R203 | Ref. Fab | Ref. IgG |
|---|---|---|---|---|---|---|---|---|
| EC50 | 12.09 | 0.09343 | 3.320 | 0.6930 | 2.183 | 0.3041 | 0.1165 | 0.01209 |

INTERLEUKIN-6 RECEPTOR BINDING POLYPEPTIDES

RELATED APPLICATIONS

This application is a national stage filing under 35 U.S.C. §371 of international application PCT/EP2007/058587, filed Aug. 17, 2007, which was published under PCT Article 21(2) in English, and claims the benefit under 35 U.S.C. §119(e) of U.S. provisional application serial number 60/838,904, filed Aug. 18, 2006, U.S. provisional application serial number 60/873,012, filed Dec. 5, 2006, and U.S. provisional application serial number 60/938,325, filed May. 16, 2007, the disclosures of which are incorporated by reference herein in their entireties.

FIELD OF THE INVENTION

The present invention relates to amino acid sequences that are directed against (as defined herein) Interleukin-6 Receptor (IL-6R), as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

BACKGROUND OF THE INVENTION

The interaction of IL-6, a protein originally identified as a B cell differentiation factor (Hirano et al., 1985; EP0257406), with IL-6R (Yamasaki et al., 1988; EP0325474) results in the formation of the IL-6/IL-6R complex. This complex binds to gp130 (Taga et al., 1989; EP0411946), a membrane protein on a target cell, which transmits various physiological actions of IL-6. IL-6 is currently known to be involved in—amongst others—the regulation of the immune response, hematopoiesis, the acute phase response, bone metabolism, angiogenesis, and inflammation. Deregulation of IL-6 production is implicated in the pathology of several autoimmune and chronic inflammatory proliferative disease processes (Ishihara and Hirano, 2002). As a consequence, inhibitors of IL-6 induced signaling have attracted much attention in the past (Hirano et al., 1990). Polypeptides specifically binding to IL-6 (Klein et al., 1991; EP0312996), IL-6R (EP0409607) or gp130 (Saito et al., 1993; EP0572118) proved to exhibit an efficient inhibitory effect on IL-6 functioning.

IL-6 overproduction and signalling (and in particular so-called trans-signalling) are involved in various diseases and disorders, such as sepsis (Starnes et al., 1999) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992; Jilka et al., 1992), cachexia (Strassman et al., 1992), psoriasis, mesangial proliferative glomerulonephritis, Kaposi's sarcoma, AIDS-related lymphoma (Emilie et al., 1994), inflammatory diseases and disorder such as rheumatoid arthritis, systemic onset juvenile idiopathic arthritis, hyper-gammaglobulinemia (Grau et al., 1990); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991). Other IL-6 related disorders will be clear to the skilled person.

As can for example be seen from the references above, the prior art describes antibodies and antibody fragments directed against human IL-6, against human IL-6R and against human gp130 protein for the prevention and treatment of IL-6 relates disorders. Examples are Tocilizumab (see Woo P, et al. Arthritis Res Ther. (2005) 7: 1281-8, Nishimoto N et al. Blood. (2005) 106: 2627-32, Ito H et al. Gastroenterology. (2004) 126: 989-96, Choy E H et al. Arthritis Rheum. (2002) 46: 3143-50), BE8 (see Bataille R et al. Blood (1995) 86:685-91, Emilie D et al. Blood (1994) 84:2472-9, Beck J T et al. N Engl J. Med. (1994) 330:602-5, Wendling D et al. J Rheumatol. (1993) 20:259-62) and CNTO-328 of Centocor (see Journal of Clinical Oncology, (2004) 22/14S: 2560; Journal of Clinical Oncology, (2004) 22/14S: 2608; Int J Cancer (2004) 111:592-5). Another active principle known in the art for the prevention and treatment of IL-6 related disorders is an Fc fusion of soluble gp130 (see Becker C et al. Immunity. (2004) 21: 491-501, Doganci A et al. J Clin Invest. (2005) 115:313-25, Nowell M A et al. J. Immunol. (2003) 171: 3202-9, Atreya R et al. Nat. Med. (2000) 6:583-8.)

SUMMARY OF THE INVENTION

The amino acid sequences, polypeptides and compositions of the present invention can generally be used to modulate, and in particular inhibit and/or prevent, binding of IL-6R to IL-6 and/or binding of the IL-6/IL-6R complex to gp130 and thus to modulate, and in particular inhibit or prevent, the signalling that is mediated by IL-6R, IL-6, IL6/IL-6R complex or gp130 to modulate the biological pathways in which IL-6R, IL-6, the IL6/IL-6R complex and/or gp130 are involved, and/or to modulate the biological mechanisms, responses and effects associated with such signalling or these pathways.

In the context of the present invention "modulating the interaction between IL-6/IL-6R complex and gp130" can for example mean:

binding to IL-6R (i.e. as such or as present in the IL-6/IL-6R complex) in such a way that the formation of the IL-6/IL-6R complex is inhibited or affected (e.g. fully or partially disrupted) in such a way that the binding of the complex to—e.g. its affinity for—gp130 is reduced (or reversely, that the binding of gp 130 to—e.g. its affinity for—the complex is reduced), so that the signaling induced/mediated by the binding of the complex to gp130 is modulated (e.g. reduced);

or binding to IL-6R (i.e. as such or as present in the IL-6/IL-6R complex) in such a way that the formation of the IL-6/IL-6R complex essentially is not affected but that the binding of said complex to gp130 is modulated (e.g. inhibited), so that the signalling induced/mediated by the binding of the complex to gp130 is modulated (e.g. reduced);
both compared to the formation of the complex and its binding to gp130 without the presence of the amino acid sequence or Nanobody of the invention.

Accordingly, in one specific, but non-limiting aspect, the invention provides polypeptides and compositions that are, and/or that can be used as, an antagonist of IL-6, of IL-6R, of IL-6- or IL-6R-mediated signalling, and/or of the biological pathways mechanisms, responses and/or effects in which IL-6, IL-6R and/or IL-6- or IL-6R mediated signalling are involved.

As such, the amino acid sequences, polypeptides and compositions of the invention may for example bind an epitope that lies in, forms part of, or overlaps with (i.e. in the primary or tertiary structure) or is in close proximity to (i.e. in the primary or tertiary structure) to the IL-6 binding site on IL-6R (for example, competitively with IL-6); bind an epitope that lies in, forms part of, or overlaps with (i.e. in the primary or tertiary structure) or is in close proximity to (i.e. in the primary or tertiary structure) the gp130 binding site on IL-6R (for example, competitively with gp130); and/or bind an epitope that lies in, forms part of, or overlaps with (i.e. in the primary or tertiary structure) or is in close proximity to (i.e. in the primary or tertiary structure) the gp 130 binding site on the complex (for example, competitively with gp 130). Preferably, any such epitope is an extracellular epitope. Some specific epitopes to which the amino acid sequences, Nanobodies and polypeptides of the invention may preferably bind will become clear from the further description herein.

As such, the amino acid sequences, polypeptides and compositions of the present invention can be used for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6 and/or the IL-6/IL-6R complex (optionally in further complex with gp130) are involved, and in particular for the prevention and treatment of diseases and disorders associated with IL-6R, IL-6 and/or with the IL-6/IL-6R complex (optionally in further complex with gp130), and/or with the signaling pathway(s) and/or the biological functions and responses in which IL-6R, IL-6 and/or with the IL-6/IL-6R complex (optionally in further complex with gp130) are involved, which are characterized by excessive and/or unwanted signalling mediated by IL-6R or by the pathway(s) in which IL-6R is involved. Examples of such diseases and disorders associated with IL-6R, IL-6 and/or with the IL-6/IL-6R complex, and/or with the signaling pathway(s) and/or the biological functions and responses in which IL-6 and/or the IL-6/IL-6R complex are involved, will be clear to the skilled person based on the disclosure herein, and for example include the following diseases and disorders: sepsis (Starnes et al., 1999) and various forms of cancer such as multiple myeloma disease (MM), renal cell carcinoma (RCC), plasma cell leukaemia (Klein et al., 1991), lymphoma, B-lymphoproliferative disorder (BLPD) and prostate cancer. Non-limiting examples of other diseases caused by excessive IL-6 production or signalling include bone resorption (osteoporosis) (Roodman et al., 1992; Jilka et al., 1992), cachexia (Strassman et al., 1992), psoriasis, mesangial proliferative glomerulonephritis, Kaposi's sarcoma, AIDS-related lymphoma (Emilie et al., 1994), inflammatory diseases and disorder such as rheumatoid arthritis, systemic onset juvenile idiopathic arthritis, hypergammaglobulinemia (Grau et al., 1990); Crohn's disease, ulcerative colitis, systemic lupus erythematosus (SLE), multiple sclerosis, Castleman's disease, IgM gammopathy, cardiac myxoma, asthma (in particular allergic asthma) and autoimmune insulin-dependent diabetes mellitus (Campbell et al., 1991). Other IL-6R, IL-6 and/or IL-6/IL-6R complex related disorders will be clear to the skilled person. Such diseases and disorders are also generally referred to herein as "IL-6R related disorders".

Thus, without being limited thereto, the amino acid sequences and polypeptides of the invention can for example be used to prevent and/or to treat all diseases and disorders that are currently being prevented or treated with active principles that can modulate IL-6R-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences and polypeptides of the invention will become clear to the skilled person from the further disclosure herein.

DETAILED DESCRIPTION OF THE INVENTION

Generally, it is an object of the invention to provide pharmacologically active agents, as well as compositions comprising the same, that can be used in the diagnosis, prevention and/or treatment of one or more IL-6R related disorders (as defined herein); and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of one or more IL-6R related disorders (as defined herein); and to provide methods for the diagnosis, prevention and/or treatment of such diseases and disorders that involve the administration and/or the use of such therapeutic proteins and compositions.

Accordingly, it is a specific object of the present invention to provide amino acid sequences and polypeptides that are directed against (as defined herein) IL-6R, in particular against IL-6R from a warm-blooded animal, more in particular against IL-6R from a mammal, and especially against human IL-6R; and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more IL-6R related disorders (as defined herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more IL-6R related disorders (as defined herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences and polypeptides that are directed against (as defined herein) and/or can specifically bind (as defined herein) to IL-6R; as well as compounds and constructs, and in particular proteins and polypeptides, that comprise at least one such amino acid sequence.

More in particular, the invention provides amino acid sequences that can bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:

bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to IL-6R with a $k_{on}$-rate of between $10^2$ M$^{-1}$s$^{-1}$ to about $10^7$ M$^{-1}$s$^{-1}$, preferably between $10^3$ M$^{-1}$s$^{-1}$ and $10^7$ M$^{-1}$s$^{-1}$, more preferably between $10^4$ and $10^7$ M$^{-1}$s$^{-1}$, such as between $10^5$ M$^{-1}$s$^{-1}$ and $10^7$ M$^{-1}$s$^{-1}$;

and/or such that they:

bind to IL-6R with a $k_{off}$-rate between 1 s$^{-1}$ ($t_{1/2}$=0.69 s) and $10^{-6}$ s$^{-1}$ (providing a near irreversible complex with a $t_{1/2}$ of multiple days), preferably between $10^{-2}$ s$^{-1}$ and $10^{-6}$ s$^{-1}$, more preferably between $10^{-3}$ s$^{-1}$ and $10^{-6}$ s$^{-1}$, such as between $10^{-4}$ s$^{-1}$ and $10^{-6}$ s$^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 pM.

Some preferred IC50 values for binding of the amino acid sequences or polypeptides of the invention to IL-6R will become clear from the further description and examples herein.

For binding to IL-6R, an amino acid sequence of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence of the invention can bind to IL-6R, which amino acid residues or stretches of amino acid residues thus form the "site" for binding to IL-6R (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than IL-6R), so as to provide a monovalent, multivalent or multispecific polypeptide of the invention, respectively, all as described herein. Such a protein or polypeptide may also be in essentially isolated form (as defined herein).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against human IL-6R; whereas for veterinary purposes, the amino acid sequences and polypeptides of the invention are preferably directed against IL-6R from the species to be treated, or at least cross-reactive with IL-6R from the species to be treated.

Furthermore, an amino acid sequence of the invention (or compound, construct or polypeptide comprising one or more such amino acid sequences) may optionally, and in addition to the at least one binding site for binding against IL-6R, contain one or more further binding sites for binding against other antigens, proteins or targets.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include proliferation assays using IL6-dependent cell lines including B9, XG1 and 7TD1, collagen induced arthritis model, transplant model of synovial tissue in SCID mice, xenograft models of various human cancers, including lymphoma, myeloma, prostate cancer and renal cell carcinoma, IBD models including TNBS, DSS and IL10 knockout models, as well as the assays and animal models used in the experimental part below and in the prior art cited herein (Peake et al., Rheumatology 2006; 45(12):1485-9; Wahid et al.; Clin Exp Immunol. 2000, 122: 133-142; Matsuno et al., Arthritis and rheumatism, 1998, 41: 2014-2021).

Also, according to the invention, amino acid sequences and polypeptides that are directed against IL-6R from a first species of warm-blooded animal may or may not show cross-reactivity with IL-6R from one or more other species of warm-blooded animal, by which is meant that these amino acid sequences are also "directed against" (as defined herein) and/or are capable of specific binding to (as defined herein) IL-6R from said warm-blooded animal. For example, amino acid sequences and polypeptides directed against human IL-6R may or may not show cross reactivity with IL-6R from one or more other species of primates (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*)) and/or with IL-6R from one or more species of animals that are often used in animal models for diseases (for example mouse, rat, rabbit, pig or dog), and in particular in animal models for diseases and disorders associated with IL-6R (such as the species and animal models mentioned herein). In this respect, it will be clear to the skilled person that such cross-reactivity, when present, may have advantages from a drug development point of view, since it allows the amino acid sequences and polypeptides against human IL-6R to be tested in such disease models. In a preferred but non-limiting aspect, the amino acid sequences of the invention (as well as compounds, constructs and polypeptides comprising the same) may be cross-reactive with the amino acid sequence for IL-6R from *Macaca fascicularis* that is given in SEQ ID NO: 633. For this sequence and the corresponding cDNA sequence, reference is also made to the non-prepublished US provisional application filed by Ablynx N.V. on Jul. 19, 2007 entitled "Receptor for interleukin-6 (IL-6) from *Macaca fascicularis*"; see SEQ ID NO: 3 and FIG. 1B for the cDNA sequence and SEQ ID NO: 4 and FIG. 3B for the amino acid sequence.

More generally, amino acid sequences and polypeptides of the invention that are cross-reactive with IL-6R from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against IL-6R from one species of animal (such as amino acid sequences and polypeptides against human IL-6R) can be used in the treatment of another species of animal, as long as the use of the amino acid sequences and/or polypeptides provide the desired effects in the species to be treated.

The present invention is in its broadest sense also not particularly limited to or defined by a specific antigenic determinant, epitope, part, domain, subunit or confirmation (where applicable) of IL-6R against which the amino acid sequences and polypeptides of the invention are directed. However, it is generally assumed and preferred that the amino acid sequences and polypeptides of the invention are preferably directed against any epitope of the IL-6 receptor involved in the interaction of the IL-6 receptor with IL-6.

Such epitopes or interaction sites have been described in detail in Boulanger et al. (2003) (Science 300, 2101-2104) and reference is specifically made to FIG. 2 in cited reference. More preferably, the amino acid sequences and polypeptides of the present invention are directed against an extracellular domain of the IL-6 receptor. Still more preferably, the amino acid sequences and polypeptides of the present invention are directed against the extracellular D3 domain of the IL-6 receptor. Still more preferably, the amino acid sequences and polypeptides of the present invention interact with one or more of the 18 contact residues as described in Boulanger et al. 2003 (Science 300, 2101-2104) present in the extracellular D3 domain of the IL-6 receptor that contribute to the interaction of the IL-6 receptor with IL-6. Most preferably, the amino acid sequences and polypeptides of the present invention interact with amino acid residues Phe229 and Phe279 present in the extracellular D3 domain of the IL-6 receptor.

Thus, in one preferred, but non-limiting aspect, the amino acid sequences and polypeptides of the invention are directed against any epitope of the IL-6 receptor involved in the interaction of the IL-6 receptor with IL-6, and are as further defined herein.

Alternatively, the amino acid sequences and polypeptides of the invention are directed against any epitope of the IL-6 receptor involved in the interaction of the IL-6 receptor with gp130. Such epitopes or interaction sites have been described in detail in Boulanger et al. (2003) (Science 300, 2101-2104) and reference is specifically made to FIG. 2 in cited reference.

In this context, according to a non-limiting aspect, amino acid sequences and polypeptides of the invention are preferably such that they can compete for binding to the IL-6 receptor with the commercially available human-mouse reconstituted chimeric monoclonal anti-IL6R antibody Tocilizumab (MRA) (Chugai/Roche) or an antigen binding fragment thereof (see for example WO 92/19759 and corresponding European patent EP 0628639, as well as Shinkura et al., 1998, Anticancer Research 18, 1217-1222), for example in the assay described in Example 29; and/or such that they can bind to the same epitope or binding site on IL-6R as Tocilizumab, or to an epitope close to said binding site and/or overlapping with said binding site.

Also, according to a non-limiting aspect, amino acid sequences and polypeptides of the invention are preferably such that they can compete for binding to the IL-6 receptor with the reference IgG and/or reference Fab according to patent EP 0628639; and/or such that they can bind to the same epitope or binding site on IL-6R as said reference IgG or reference Fab, or to an epitope close to said binding site and/or overlapping with said binding site. For the preparation and sequence of said reference IgG and reference Fab, reference is made to Reference Example 1 below, as well as to SEQ ID NO's: 629 to 632.

Thus, generally and without limitation, amino acid sequences and polypeptides of the invention may be directed against any epitope of the IL-6 receptor involved in the interaction of the IL-6 receptor with IL-6 and/or gp130.

The amino acid sequences and polypeptides of the invention are also preferably (but without limitation) such that they effect a decrease (i.e. by at least 1 percent such as by at least 10 percent or more) in the levels of C-reactive protein (CRP) in a mammal (such as a human subject or in a suitable animal model for inflammation such as the cynomolgus monkey model used in the experimental part below) when they are administered to said mammal in a therapeutically relevant amount.

It is also within the scope of the invention that, where applicable, an amino acid sequence or polypeptide of the invention can bind to two or more antigenic determinants, epitopes, parts, domains, subunits or confirmations of IL-6R. In such a case, the antigenic determinants, epitopes, parts, domains or subunits of IL-6R to which the amino acid sequences and/or polypeptides of the invention bind may be essentially the same (for example, if IL-6R contains repeated structural motifs or occurs in a multimeric form) or may be different (and in the latter case, the amino acid sequences and polypeptides of the invention may bind to such different antigenic determinants, epitopes, parts, domains, subunits of IL-6R with an affinity and/or specificity which may be the same or different). Also, for example, when IL-6R exists in an activated conformation and in an inactive conformation, the amino acid sequences and polypeptides of the invention may bind to either one of these confirmation, or may bind to both these confirmations (i.e. with an affinity and/or specificity which may be the same or different). Also, for example, the amino acid sequences and polypeptides of the invention may bind to a conformation of IL-6R in which it is bound to a pertinent ligand, may bind to a conformation of IL-6R in which it not bound to a pertinent ligand, or may bind to both such conformations (again with an affinity and/or specificity which may be the same or different).

It is also expected that the amino acid sequences and polypeptides of the invention will generally bind to all naturally occurring or synthetic analogs, variants, mutants, alleles, parts and fragments of IL-6R; or at least to those analogs, variants, mutants, alleles, parts and fragments of IL-6R that contain one or more antigenic determinants or epitopes that are essentially the same as the antigenic determinant(s) or epitope(s) to which the amino acid sequences and polypeptides of the invention bind in IL-6R (e.g. in wild-type IL-6R). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) IL-6R. It is also included within the scope of the invention that the amino acid sequences and polypeptides of the invention bind to some analogs, variants, mutants, alleles, parts and fragments of IL-6R, but not to others.

When IL-6R exists in a monomeric form and in one or more multimeric forms, it is within the scope of the invention that the amino acid sequences and polypeptides of the invention only bind to IL-6R in monomeric form, only bind to IL-6R in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

Also, when IL-6R can associate with other proteins or polypeptides to form protein complexes (e.g. with multiple subunits), it is within the scope of the invention that the amino acid sequences and polypeptides of the invention bind to IL-6R in its non-associated state, bind to IL-6R in its associated state, or bind to both. In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to IL-6R in its monomeric and non-associated state.

Also, as will be clear to the skilled person, proteins or polypeptides that contain two or more amino acid sequences directed against IL-6R may bind with higher avidity to IL-6R than the corresponding monomeric amino acid sequence(s). For example, and without limitation, proteins or polypeptides that contain two or more amino acid sequences directed against different epitopes of IL-6R may (and usually will) bind with higher avidity than each of the different monomers, and proteins or polypeptides that contain two or more amino acid sequences directed against IL-6R may (and usually will) bind also with higher avidity to a multimer of IL-6R.

Generally, amino acid sequences and polypeptides of the invention will at least bind to those forms of IL-6R (including monomeric, multimeric and associated forms) that are the most relevant from a biological and/or therapeutic point of view, as will be clear to the skilled person.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against IL-6R; and more preferably will be capable of specific binding to IL-6R, and even more preferably capable of binding to IL-6R with an affinity (suitably measured and/or expressed as a $K_D$-value (actual or apparent), a $K_A$-value (actual or apparent), a $k_{on}$-rate and/or a $k_a$-rate, or alternatively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to IL-6R; and more preferably capable of binding to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody® (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(10:484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.] Such Nanobodies directed against IL-6R will also be referred to herein as "Nanobodies of the invention".

For a general description of Nanobodies, reference is made to the further description below, as well as to the prior art cited herein. In this respect, it should however be noted that this description and the prior art mainly described Nanobodies of the so-called "$V_H3$ class" (i.e. Nanobodies with a high degree of sequence homology to human germline sequences of the $V_H3$ class such as DP-47, DP-51 or DP-29), which Nanobodies form a preferred aspect of this invention. It should however be noted that the invention in its broadest sense generally covers any type of Nanobody directed against IL-6R, and for example also covers the Nanobodies belonging to the so-called "$V_H4$ class" (i.e. Nanobodies with a high degree of sequence homology to human germline sequences of the $V_H4$ class such as DP-78), as for example described in the U.S. provisional application 60/792,279 by Ablynx N.V. entitled "DP-78-like Nanobodies" filed on Apr. 14, 2006.

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

Thus, the invention also relates to such Nanobodies that can bind to (as defined herein) and/or are directed against IL-6R, to suitable fragments thereof, as well as to polypeptides that comprise or essentially consist of one or more of such Nanobodies and/or suitable fragments.

SEQ ID NO's 399 to 471 give the amino acid sequences of a number of $V_{HH}$ sequences that have been raised against IL-6R.

Accordingly, some particularly preferred Nanobodies of the invention are Nanobodies which can bind (as further defined herein) to and/or are directed against to IL-6R and which:

a) have 80% amino acid identity with at least one of the amino acid sequences of SEQ ID NO's: 399 to 471, in which for the purposes of determining the degree of amino acid identity, the amino acid residues that form the CDR sequences are disregarded. In this respect, reference is also made to Table A-1, which lists the framework 1 sequences (SEQ ID NO's: 42 to 92), framework 2 sequences (SEQ ID NO's: 144 to 194), framework 3 sequences (SEQ ID NO's: 246 to 296) and framework 4 sequences (SEQ ID NO's: 348 to 398) of the Nanobodies of SEQ ID NO's: 399 to 471 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

b) preferably one or more of the amino acid residues at positions 11, 37, 44, 45, 47, 83, 84, 103, 104 and 108 according to the Kabat numbering are chosen from the Hallmark residues mentioned in Table A-3 below (it being understood that $V_{HH}$ sequences will contain one or more Hallmark residues; and that partially humanized Nanobodies will usually, and preferably, [still] contain one or more Hallmark residues [although it is also within the scope of the invention to provide—where suitable in accordance with the invention—partially humanized Nanobodies in which all Hallmark residues, but not one or more of the other amino acid residues, have been humanized]; and that in fully humanized Nanobodies, where suitable in accordance with the invention, all amino acid residues at the positions of the Hallmark residues will be amino acid residues that occur in a human $V_H3$ sequence. As will be clear to the skilled person based on the disclosure herein that such $V_{HH}$ sequences, such partially humanized Nanobodies with at least one Hallmark residue, such partially humanized Nanobodies without Hallmark residues and such fully humanized Nanobodies all form aspects of this invention).

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention. Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Some particularly preferred humanized Nanobodies of the invention are humanized variants of the Nanobodies of SEQ ID NO's: 399 to 471.

Thus, some other preferred Nanobodies of the invention are Nanobodies which can bind (as further defined herein) to IL-6R and which:

a) are a humanized variant of one of the amino acid sequences of SEQ ID NO's: 399 to 471; and/or b) have 80% amino acid identity with at least one of the amino acid sequences of SEQ ID NO's: 399 to 471, in which for the purposes of determining the degree of amino acid identity, the amino acid residues that form the CDR sequences are disregarded;

and in which:

c) preferably one or more of the amino acid residues at positions 11, 37, 44, 45, 47, 83, 84, 103, 104 and 108 according to the Kabat numbering are chosen from the Hallmark residues mentioned in Table A-3 below Some preferred, but non-limiting examples of humanized Nanobodies of the Invention are given in SEQ ID NO's: 609 to 628.

According to another specific aspect of the invention, the invention provides a number of stretches of amino acid residues (i.e. small peptides) that are particularly suited for binding to IL-6R. These stretches of amino acid residues may be present in, and/or may be incorporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against IL-6R (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to IL-6R. Thus, generally, the invention in its broadest sense comprises any amino acid sequence that is capable of binding to IL-6R and that comprises one or more CDR sequences as described herein and, and in particular a suitable combination of two or more such CDR sequences, that are suitably linked to each other via one or more further amino acid sequences, such that the entire amino acid sequence forms a binding domain and/or binding unit that is capable of binding to IL-6R. It should however also be noted that the presence of only one such CDR sequence in an amino acid sequence of the invention may by itself already be sufficient to provide an amino acid sequence of the invention that is capable of binding to IL-6R; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al, Nat. Biotech 2005, Vol 23:1257), and binding moieties based on DNA or RNA including but not limited to DNA or RNA aptamers (Ulrich et al. Comb Chem High Throughput Screen 2006 9(8):619-32).

Again, any amino acid sequence of the invention that comprises one or more of these CDR sequences is preferably such that it can specifically bind (as defined herein) to IL-6R, and more in particular such that it can bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR 1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against IL-6R, that comprises one or more stretches of amino acid residues chosen from the group consisting of:

a) the amino acid sequences of SEQ ID NO's: 93 to 143;
b) amino acid sequences that have at least 80% amino acid identity with at least one of the amino acid sequences of SEQ ID NO's: 93 to 143;
c) amino acid sequences that have 3, 2, or 1 amino acid difference with at least one of the amino acid sequences of SEQ ID NO's: 93 to 143;
d) the amino acid sequences of SEQ ID NO's: 195 to 245;
e) amino acid sequences that have at least 80% amino acid identity with at least one of the amino acid sequences of SEQ ID NO's: SEQ ID NO's: 195 to 245;
f) amino acid sequences that have 3, 2, or 1 amino acid difference with at least one of the amino acid sequences of SEQ ID NO's: 195 to 245;
g) the amino acid sequences of SEQ ID NO's: 297 to 347;
h) amino acid sequences that have at least 80% amino acid identity with at least one of the amino acid sequences of SEQ ID NO's: 297 to 347;
i) amino acid sequences that have 3, 2, or 1 amino acid difference with at least one of the amino acid sequences of SEQ ID NO's: 297 to 347;
or any suitable combination thereof.

When an amino acid sequence of the invention contains one or more amino acid sequences according to b) and/or c):

i) any amino acid substitution in such an amino acid sequence according to b) and/or c) is preferably, and compared to the corresponding amino acid sequence according to a), a conservative amino acid substitution, (as defined herein); and/or ii) the amino acid sequence according to b) and/or c) preferably only contains amino acid substitutions, and no amino acid deletions or insertions, compared to the corresponding amino acid sequence according to a); and/or iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):

i) any amino acid substitution in such an amino acid sequence according to e) and/or f) is preferably, and compared to the corresponding amino acid sequence according to d), a conservative amino acid substitution, (as defined herein); and/or ii) the amino acid sequence according to e) and/or f) preferably only contains amino acid substitutions, and no amino acid deletions or insertions, compared to the corresponding amino acid sequence according to d); and/or iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein); and/or ii) the amino acid sequence according to h) and/or i) preferably only contains amino acid substitutions, and no amino acid deletions or insertions, compared to the corresponding amino acid sequence according to g); and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 93 to 143;
ii) the amino acid sequences of SEQ ID NO's: 195 to 245; and
iii) the amino acid sequences of SEQ ID NO's: 297 to 347; or any suitable combination thereof.

Also, preferably, in such an amino acid sequence, at least one of said stretches of amino acid residues forms part of the antigen binding site for binding against IL-6R.

In a more specific, but again non-limiting aspect, the invention relates to an ammo acid sequence directed against IL-6R, that comprises two or more stretches of amino acid residues chosen from the group consisting of:
a) the amino acid sequences of SEQ ID NO's: 93 to 143;
b) amino acid sequences that have at least 80% amino acid identity with at least one of the amino acid sequences of SEQ ID NO's: 93 to 143;
c) amino acid sequences that have 3, 2, or 1 amino acid difference with at least one of the amino acid sequences of SEQ ID NO's: 93 to 143;
d) the amino acid sequences of SEQ ID NO's: 195 to 245;
e) amino acid sequences that have at least 80% amino acid identity with at least one of the amino acid sequences of SEQ ID NO's: 195 to 245;
f) amino acid sequences that have 3, 2, or 1 amino acid difference with at least one of the amino acid sequences of SEQ ID NO's: 195 to 245;
g) the amino acid sequences of SEQ ID NO's: 297 to 347;
h) amino acid sequences that have at least 80% amino acid identity with at least one of the amino acid sequences of SEQ ID NO's: 297 to 347;
i) amino acid sequences that have 3, 2, or 1 amino acid difference with at least one of the amino acid sequences of SEQ ID NO's: 297 to 347;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 93 to 143;
ii) the amino acid sequences of SEQ ID NO's: 195 to 245; and
iii) the amino acid sequences of SEQ ID NO's: 297 to 347;
such that, (i) when the first stretch of amino acid residues corresponds to one of the amino acid sequences of SEQ ID NO's: 93 to 143, the second stretch of amino acid residues corresponds to one of the amino acid sequences of SEQ ID NO's: 195 to 245 or of SEQ ID NO's: 297 to 347; (ii) when the first stretch of amino acid residues corresponds to one of the amino acid sequences of SEQ ID NO's: 195 to 245, the second stretch of amino acid residues corresponds to one of the amino acid sequences of SEQ ID NO's: 93 to 143 or of SEQ ID NO's: 297 to 347; or (iii) when the first stretch of amino acid residues corresponds to one of the amino acid sequences of SEQ ID NO's: 297 to 347, the second stretch of amino acid residues corresponds to one of the amino acid sequences of SEQ ID NO's: 93 to 143 or of SEQ ID NO's: 195 to 245.

Also, in such an amino acid sequence, the at least two stretches of amino acid residues again preferably form part of the antigen binding site for binding against IL-6R.

In an even more specific, but non-limiting aspect, the invention relates to an amino acid sequence directed against IL-6R, that comprises three or more stretches of amino acid residues, in which the first stretch of amino acid residues is chosen from the group consisting of:
a) the amino acid sequences of SEQ ID NO's: 93 to 143;
b) amino acid sequences that have at least 80% amino acid identity with at least one of the amino acid sequences of SEQ ID NO's: 93 to 143;
c) amino acid sequences that have 3, 2, or 1 amino acid difference with at least one of the amino acid sequences of SEQ ID NO's: 93 to 143;
the second stretch of amino acid residues is chosen from the group consisting of:
d) the amino acid sequences of SEQ ID NO's: 195 to 245;
e) amino acid sequences that have at least 80% amino acid identity with at least one of the amino acid sequences of SEQ ID NO's: 195 to 245;
f) amino acid sequences that have 3, 2, or 1 amino acid difference with at least one of the amino acid sequences of SEQ ID NO's: 195 to 245;
and the third stretch of amino acid residues is chosen from the group consisting of:
g) the amino acid sequences of SEQ ID NO's: 297 to 347;
h) amino acid sequences that have at least 80% amino acid identity with at least one of the amino acid sequences of SEQ ID NO's: 297 to 347;
i) amino acid sequences that have 3, 2, or 1 amino acid difference with at least one of the amino acid sequences of SEQ ID NO's: 297 to 347.

Preferably, in this specific aspect, the first stretch of amino acid residues is chosen from the group consisting of the amino acid sequences of SEQ ID NO's: 93 to 143; the second stretch of amino acid residues is chosen from the group consisting of the amino acid sequences of SEQ ID NO's: 195 to 245; and the third stretch of amino acid residues is chosen from the group consisting of the amino acid sequences of SEQ ID NO's: 297 to 347.

Again, preferably, in such an amino acid sequence, the at least three stretches of amino acid residues forms part of the antigen binding site for binding against IL-6R.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's 399 to 471

Also, such amino acid sequences are preferably such that they can specifically bind (as defined herein) to IL-6R; and more in particular bind to IL-6R with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 93 to 143;
b) amino acid sequences that have at least 80% amino acid identity with at least one of the amino acid sequences of SEQ ID NO's: 93 to 143;
c) amino acid sequences that have 3, 2, or 1 amino acid difference with at least one of the amino acid sequences of SEQ ID NO's: 93 to 143;
and/or
CDR2 is chosen from the group consisting of:
d) the amino acid sequences of SEQ ID NO's: 195 to 245;
e) amino acid sequences that have at least 80% amino acid identity with at least one of the amino acid sequences of SEQ ID NO's: 195 to 245;
f) amino acid sequences that have 3, 2, or 1 amino acid difference with at least one of the amino acid sequences of SEQ ID NO's: 195 to 245;
and/or
CDR3 is chosen from the group consisting of
g) the amino acid sequences of SEQ ID NO's: 297 to 347;
h) amino acid sequences that have at least 80% amino acid identity with at least one of the amino acid sequences of SEQ ID NO's: 297 to 347;
i) amino acid sequences that have 3, 2, or 1 amino acid difference with at least one of the amino acid sequences of SEQ ID NO's: 297 to 347.

In particular, such an amino acid sequence of the invention may be such that CDR1 is chosen from the group consisting of the amino acid sequences of SEQ ID NO's: 93 to 143; and/or CDR2 is chosen from the group consisting of the amino acid sequences of SEQ ID NO's: 195 to 245; and/or CDR3 is chosen from the group consisting of the amino acid sequences of SEQ ID NO's: 297 to 347.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 93 to 143;
b) amino acid sequences that have at least 80% amino acid identity with at least one of the amino acid sequences of SEQ ID NO's: 93 to 143;
c) amino acid sequences that have 3, 2, or 1 amino acid difference with at least one of the amino acid sequences of SEQ ID NO's: 93 to 143;
and
CDR2 is chosen from the group consisting of:
d) the amino acid sequences of SEQ ID NO's: 195 to 245;
e) amino acid sequences that have at least 80% amino acid identity with at least one of the amino acid sequences of SEQ ID NO's: 195 to 245;

f) amino acid sequences that have 3, 2, or 1 amino acid difference with at least one of the amino acid sequences of SEQ ID NO's: 195 to 245;
and
CDR3 is chosen from the group consisting of:
g) the amino acid sequences of SEQ ID NO's: 297 to 347;
h) amino acid sequences that have at least 80% amino acid identity with at least one of the amino acid sequences of SEQ ID NO's: 297 to 347;
i) amino acid sequences that have 3, 2, or 1 amino acid difference with at least one of the amino acid sequences of SEQ ID NO's: 297 to 347; or any suitable fragment of such an amino acid sequence In particular, such an amino acid sequence of the invention may be such that CDR1 is chosen from the group consisting of the amino acid sequences of SEQ ID NO's: 93 to 143; and CDR2 is chosen from the group consisting of the amino acid sequences of SEQ ID NO's: 195 to 245; and CDR3 is chosen from the group consisting of the amino acid sequences of SEQ ID NO's: 297 to 347.

Again, preferred combinations of CDR sequences will become clear from the further description herein.

Also, such amino acid sequences are preferably such that they can specifically bind (as defined herein) to IL-6R; and more in particular bind to IL-6R with an affinity (suitably measured and/or expressed as a $1K_D$-value (actual or apparent), a $K_A$-value (actual or apparent), a $IC_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 399 to 471. This degree of amino acid identity can for example be determined by determining the degree of amino acid identity (in a manner described herein) between said amino acid residue and one or more of the sequences of SEQ ID NO's: 399 to 471, in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_s$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody® (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody®. Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531).

TABLE A-1

Preferred combinations of CDR and framework sequences.

| CLONE | ID FR1 | ID CDR1 | ID FR2 | ID CDR2 | ID FR3 | ID CDR3 | ID FR4 |
|---|---|---|---|---|---|---|---|
| PMP40C9(t) | 42 EVQLVESGGGLVQPGGSLRLSCAASGFSLD | 93 YYAIG | 144 WFRQAPGKEREGVS | 195 CMDSSAGTT STYYSDSVKG | 246 RFTISRDDAKN TVYLQMNSLKP EDTAVYYCAA | 297 DGHLNWGQ RYVPCSQIS WRGWNDY | 348 WGQGTQVTVSS |
| PMP34F8(t) | 43 EVQLVESGGGLVQPGGSLRLSCAASGFSLD | 94 YYAIG | 145 WFRQAPGK ERERGVS | 196 CMDSDGTT NTYYSDSVKG | 247 RFTISRDDAKN TVYLQMNSLKP EDTASYYCAA | 298 DGHLNWGQ PYVPCSQIS WRGWNDY | 349 WGQGTQ VTVSS |
| PMP34E9(t) | 44 EVQLVESGGGLVQPGGSLRLSCAASGFTLD | 95 YYAIG | 146 WFRQAPGK ERERGVS | 197 CISSSDGSTY YADSVKG | 248 RFTISRDNAKN TVYLQMNSLKP EDTAAYYCAT | 299 DRSVYYCSG DAPEEYY | 350 WGQGTQVTVSS |
| PMP34D2(t) | 45 EVQLVESGGGLVQPGGSLRLSCAASGFTLD | 96 YFAIG | 147 WFRQAPGK ERERGVS | 198 CISSSDGSTY YADSVKG | 249 RFTISRDNAKN TVYLQMNSLKP EDTAVYYCAT | 300 DRSVYYCSG GAPEEYY | 351 WGQGTQ VTVSS |
| PMP34C3(t) | 46 EVQLVESGGGLVQPGGSLRLSCVASGFSLD | 97 YVVIG | 148 WFRQAPGK ERERGVS | 199 CISSSDGSTY YADSVKG | 250 RFTISRDNAKN TVYLQMNSLKP EDTAVYYCAA | 301 DLLRTPEFC VDSAPYDY | 352 WGRGTQ VTVSS |
| PMP34A5(t) | 47 EVQLVESGGGLVQPGGSLRLSCAASGFTLG | 98 YFAIG | 149 WFRQAPGKEREGVS | 200 CISSSDGSTY YADSVKG | 251 RFTVSRDNAK NTVYLQMNSLK PEDTAVYYCAT | 302 DRSVYYCSG GAPEEYY | 353 WGQGTQ VTVSS |
| PMP33G3(t) | 48 EVQLVESGGGLVQPGGSLRLSCAASGFTLG | 99 YFAIG | 150 WFRQAPG KEREGVS | 201 CISSSDGSA YYADSVKG | 252 RFTVSRDNA KNTVYLQMN SLKPEDTAVY YCAT | 303 DRSVYYCS GGAPEEYY | 354 WGQGT QVTVSS |
| PMP33C10(t) | 49 EVQLVESGGGLVQPGGSLRLSCAASGFTFD | 100 DYGMS | 151 WFRQAPG KGLEWVS | 202 AISWNGGS TYYTESMKG | 253 RFTISRDNAK NTVYLQMNS LKPEDTAVYY CVK | 304 GSTAIVGV PPTYPDEY DY | 355 WGQGTQVTVSS |
| PMP33A2(t) | 50 EVQLVESGGGLVQPGGSLRLSCAASGFSLD | 101 YYAIG | 152 WFRQAPG KEREGVS | 203 CMDSSGGTT STYYSDSVKG | 254 RFTISRDDAKN TVYLQMNSLKP EDTAVYYCAA | 305 DGHLNWGQ RYVPCSQIS WRGWNDY | 356 WGQGT QVTVSS |
| PMP32H5(t) | 51 EVQLVESGGGLVQPGGSLRLSCAASGFTFG | 102 SYDMS | 153 WVRQAPG KGPEWVS | 204 AINSGGGST YYADSVKG | 255 RFTISRDNAKN TLYLQMNSLKP EDTAVYYCAT | 306 DWRYSDYDL PLPPPGDY | 357 WGQGTQVTVSS |
| PMP32F10(t) | 52 EVQLVESGGGLVQAGGSLRLSCAASGFTFD | 103 DYAIG | 154 WFRQAPG KEREGIS | 205 CISSSDGST YYADSVKG | 256 RFTISSDNAKN TVYLQMNSLKP EDTAVYYCAA | 307 EPPDSSWIL DGSPEFFKF | 358 WGQGT QVTVSS |

TABLE A-1-continued

Preferred combinations of CDR and framework sequences.

| CLONE | ID FR1 | ID CDR1 | ID FR2 | ID CDR2 | ID FR3 | ID CDR3 | ID FR4 |
|---|---|---|---|---|---|---|---|
| PMP31F4(t) | 53 EVQLVESGGGLVQPGGSLRLSCAASGFTFG | 104 SYDMS | 155 WVRQAPGKGPEWVS | 206 AINSGGGST YYADSVKG | 257 RFTISRDNAKN TLYLQMNSLKP EDTAVYYCAT | 308 DWRYSDYDL PLPPPGDY | 359 WGQGT QVTVSS |
| PMP31D2(t) | 54 EVQLVESGGGLVQAGGSLRLSCAASGFTFD | 105 DYAIG | 156 WFRQAPG KEREGVS | 207 GISSSDGNT YYADSVKG | 258 RFTISSDNAKN TVYLQMNSLKP EDTAVYYCAA | 309 EPPDSNWYL DGSPEFFKF | 360 WGQGT QVTVSS |
| PMP31C8(t) | 55 EVQLVESGGGLVQPGGSLRLSCAASGFTFG | 106 SYDMS | 157 WVRQAPG KGPEWVS | 208 AINSGGGST YYADSVKG | 259 RFTISRDNAKN TLYLQMNSLKP EDTAVYYCAT | 310 DWRYSDYDL PLPPPGDY | 361 WGQGT QVTVSS |
| PMP31C5(t) | 56 EVQLVESGGGLVQAGGSLRLSCAASGFTFD | 107 DYAIG | 158 WFRQAPG KEREGVS | 209 CISSSDGST YYADSVKG | 260 RFTISRDNAKN TVYLMNNSLKP EDTAVYYCAA | 311 EPPDSMWSL DGSPEFFKF | 362 WGQGT QVTVSS |
| PMP31B4(t) | 57 EVQLVESGGGLVQPGGSLRLSCAASGFTFG | 108 SYDMS | 159 WVRQAPG KGPEWVS | 210 AINSGGGST YYADSVKG | 261 RFTISRDNAKN TVYLQMNSLKP EDTAVYYCAT | 312 DWRYSDYDL PLPPPGDY | 363 WGQGT QVTVSS |
| PMP31B11(t) | 58 EVQLVESGGGLVQPGGSLRLSCAASGFTFG | 109 SYDMS | 160 WVRQAPG KGPEWVS | 211 AINSGGGST YYADSVKG | 262 RFTISRDNAKN TVYLQMNSLKP EDTAVYYCAT | 313 DWRYSDYDL PLPPPGDY | 364 WGQGTQ VTVSS |
| PMP30G11(t) | 59 EVQLVESGGGLVQPGGSLRLSCVASGFSLD | 110 YVIG | 161 WFRQAPG KEREGVS | 212 CISSSDGSTY YADSVKG | 263 RFTISRDNAKN TVYLQMNSLKP EDTAVYYCAA | 314 DLLRTPEFC VDSAPYDY | 365 WGQGTQ VTVSS |
| PMP30B6(t) | 60 EVQLVESGGGLVQPGGSLRLSCAASGFTLD | 111 YVIG | 162 WFRQAPG KEREAVA | 213 CISSSDRSTY YADSVKG | 264 RFTISRDNAKN TGYLQMNSLK PEDTAVYYCAA | 315 DLLRTPEFC SDSAPYDY | 366 WGQGTQVTVSS |
| PMP30B1(t) | 61 EVQLVESGGGLVQPGGSLRLSCAASGFTLD | 112 YYAIG | 163 WFRQAPG KGREGVS | 214 CISSGDGST NYADSVKG | 265 RFTISRDNAKN TVYLQMNSLKP EDTAVYYCAT | 316 DRSVYYCSG GAPEEYY | 367 WGQGTQ VTVSS |
| PMP30A2(t) | 62 EVQLVESGGGLVQPGGSLRLSCAASGFTLD | 113 YVIG | 164 WFRQAPGKEREGVS | 215 CIGSSDDST YYADSVKG | 266 RFTISRDNAKN TVYLQMNSLKP EDTAVYYCAA | 317 DLLRTPEFCT DSAPYDY | 368 WGQGTQ VTVSS |
| PMP30A10(t) | 63 EVQLVESGGGLVQPGGSLRLSCAASGFTFD | 114 DYGMS | 165 WVRQAPG KGLEWVS | 216 AISWNGGST YYTESVKG | 267 RFTISRDNAKN TVYLQMNSLKP EDTAVYYCVK | 318 GSTAIVGPP TYPDEYDY | 369 WGQGTQ VTVSS |
| PMP28H6(t) | 64 EVQLVESGGGLVQPGGSLRLSCAASGFTFG | 115 SYDMS | 166 WVRQAPG KGPEWVS | 217 AINSGGGST YYADSVKG | 268 RFTISRDNAKN TLYLQMNSLKP EDTAVYYCAT | 319 DWRYSDYDL PLPPPGDY | 370 WGQGTQ VTVSS |

TABLE A-1-continued

Preferred combinations of CDR and framework sequences.

| CLONE | ID FR1 | ID CDR1 | ID FR2 | ID CDR2 | ID FR3 | ID CDR3 | ID FR4 |
|---|---|---|---|---|---|---|---|
| PMP28F7(t) | 65 EVQLVESGGGLVQPGGSLRLSCAASGFTFG | 116 SYDMS | 167 WFRQAPGKGPEWVS | 218 AINSGGGSTYYADSVKG | 269 RFTISRDNAKNTLYLQMNSLKPEDTAVYYCAT | 320 DWRYSDYDLPLPPPGDY | 371 WGQGTQVTVSS |
| PMP28D4(t) | 66 EVQLVESGGGLVQPGGSLRLSCAASGFTFG | 117 SYDMS | 168 WFRQAPGKGPEWVS | 219 AINSGGGSTYYADSVKG | 270 RFTISRDNAKNTLYLQMNSLKPEDTAVYYCAT | 321 DWRYSDYDLPLPPPGDY | 372 WGQGTQVTVSS |
| PMP28C7(t) | 67 EVQLVESGGGLVQPGGSLRLSCAASGFTFG | 118 SYDMS | 169 WFRQAPGKGPEWVS | 220 AINSGGDNTYYADSVKG | 271 RFTISRDNAKNTLYLQMNSLKPEDTAVYYCAT | 322 DWRYSDYDLPLPPPGDY | 373 WGQGTQVTVSS |
| PMP28B1(t) | 68 EVQLVESGGGLVQPGGSLRLSCAASGFTLN | 119 YYAIG | 170 WFRQAPGKEREGVS | 221 CISSSDGSTYYADSVKG | 272 RFTISRDNAKNTFYLQMNSLKPEDTAVYYCAA | 323 EGLGDSDSPCGAAWYNDY | 374 WGQGTQVTVSS |
| PMP28A2(t) | 69 EVQLVESGGGLVQPGGSLRLSCAASGFTFG | 120 SYDMS | 171 WFRQAPGKGPEWVS | 222 AINSGGGSTYYADSVKG | 273 RFTISRDNAKNTLYLQMNSLKPEDTAVYYCAT | 324 DWRYSDYDLPLPPPGDY | 375 WGQGTQVTVSS |
| PMP40H5 | 70 EVQLVESGGGLVQPGGSLRLSCAASGFSLD | 121 YYAIG | 172 WFRQAPGKEREGVS | 223 CMDSSSGTTSTYYSDSVKG | 274 RFTISRDNAKNTVYLQMNSLKPEDTAVYYCAA | 325 DGHLNWGQRYVPCSQISWRGWNDY | 376 WGQGTQVTVSS |
| PMP35H4 | 71 EVQLVESGGGLVQPGGSLRLSCAASGFTFD | 122 DYGMS | 173 WVRQAPGKGRATEWVS | 224 AISWNGNNTYYTESMKG | 275 RFTISRDNAKNTVYLQMNSLKPEDTAVYYCVK | 326 GSTAIVGVPPTYPDEYDY | 377 WGQGTQVTVSS |
| PMP35F4 | 72 EVQLVESGGGLVQAGGSLRLSCAASGFTFS | 123 SYDMG | 174 WYRQAPGKEREFVA | 225 IITWNSSTYYADSVKG | 276 RFTISRDNAKNTVYLQMNSLKPEDTAIYYCNA | 327 QYGLGYAEDY | 378 WGQGTQVTVSS |
| PMP35E11 | 73 EVQLVESGGGLVQAGGSLRLSCAASGFTFD | 124 DYAIG | 175 WFRQAPGKEHEGVS | 226 CISSSDGSTYYADSVKG | 277 RFTISSDNAKNTVYLQMNSLKPEDTAVYYCAA | 328 ERDVPARSLCGSYYWYDY | 379 RGQGTQVTVSS |
| PMP35C10 | 74 EVQLVESGGGLVQAGGSLRLSCAASGRTFS | 125 SYDMG | 176 WYRQAPGKEREFVA | 227 VIHWSSGSTYYADPVKG | 278 RFTISRDNAKNTVYLQMNSLKPEDTAIYYCNA | 329 FLPGPEGFHDY | 380 WGQGTQVTVSS |
| PMP34G9 | 75 EVQLVESGGGLVQAGGSLRLSCAASGRTSS | 126 SYDMT | 177 WYRQVPGKEREFVA | 228 VISWSGGSTYYADSVKG | 279 RFTISRDNAKNTVYLQMNSLKPEDTAIYYCNA | 330 YTGGGDDY | 381 WGQGTQVTVSS |
| PMP34G3 | 76 EVQLVESGGGLVQPGGSLRLSCAASGFTLD | 127 YYAIG | 178 WFRQAPGKERERVS | 229 CISSSDGSTYYADSVKG | 280 RFTISRDNAKNTVYLQMNSLKPEDTAAYYCAT | 331 DRSVYYCSGGAPEEYY | 382 WGQGTQVTVSS |

TABLE A-1-continued

Preferred combinations of CDR and framework sequences.

| CLONE | ID FR1 | ID CDR1 | ID FR2 | ID CDR2 | ID FR3 | ID CDR3 | ID FR4 |
|---|---|---|---|---|---|---|---|
| PMP34E10 | 77 EVQLVESGGGLVQAGGSLRLSCAASGRTFS | 128 SYAMG | 179 WGRQAPG KEREFVA | 230 TISWSGGST YYADSVKG | 281 RFTISRDNAKN TVYLQMNSLKP EDTAVYYCAA | 332 DLAEFKYSD YADY | 383 WGQGTQ VTVSS |
| PMP34C11 | 78 EVQLVESGGGLVQPGGSLRLSCAAAGFTLD | 129 YSAIG | 180 WFRQAPG KEREMFS | 231 CISGDGST WYADSVAG | 282 RFTISRDNAKN TVYLQMNSLKP EDTGLYICAV | 333 TGGVRGPCA YEYEY | 384 WGQGTQVTVSS |
| PMP34A12 | 79 EVQLVESGGGLVQPGGSLRLSCVASGFSLD | 130 YYVIG | 181 WFRQAPG KEREGVS | 232 CISSSDGSTY YADSVKG | 283 RFTISRDNAKN TVYLQMNSLKP EDTAVYYCAA | 334 DLLRTPEFC VDSAPYDY | 385 WGQGTQ VTVSS |
| PMP33A3 | 80 EVQLVESGGGLVQPGGSLRLSCAASGFTLD | 131 YGAIG | 182 WFRQAPGKEREGVS | 233 CISSSTGSTY YADSVKG | 284 RFTISRDNGKN TVYLQMNSLKP EDTAVYYCAA | 335 DKMWSPCL VAANEEALF EYDY | 386 WGQGTQ VTVSS |
| PMP32E2 | 81 EVQLVESGGGLVQAGGSLRLSCAASGNIFD | 132 DNTMGWT | 183 WNRQAPG KQRELVA | 234 IIATDGSTNY ADSVKG | 285 RFTISRDNAKN TVYLQMNSLKP EDTAVYYCNL | 336 FSLRLGRDY | 387 WGQGTQ VTVSS |
| PMP32E10 | 82 EVQLVESGGGLVQPGGSLRLSCAASGFTFG | 133 SYDMS | 184 WVRQAPG KGPEWVS | 235 AINSGGGST YYADSVKG | 286 RFTISRDNAKN TLYLQMNSLKP EDTAVYYCAT | 337 DWRYSDYDL PLPPPGDY | 388 WGQGTQ VTVSS |
| PMP32C9 | 83 EVQLVESGGGLVQPGGSLRLSCAASGFTFD | 134 DYDIG | 185 WFRQAPG KEREGVS | 236 GISSSDGNT YYADSVKG | 287 RFTISSDNAKN TVYLQMNSLKP EDTAVYYCAA | 338 EPPDSSWYL DGSPEFFKY | 389 WGQGTQ VTVSS |
| PMP31A4 | 84 EVQLVESGGGLVQAGGSLRLSCAASGSIFK | 135 VNAMG | 186 WYRQAPG KQRELVA | 237 GIISGGSTNY ADSVKG | 288 RLTISRDNAKN TVYLQMNSLKP EDTAVYYCSF | 339 VTTNSDYDL GRDY | 390 WGQGTQ VTVSS |
| PMP30C11 | 85 EVQLVESGGGLVQAGGSLRLSCAASGRTFS | 136 SYDMG | 187 WYRQAPG KEREFVA | 238 VISRSGSSTY YADSVKG | 289 RFTISRDNAKNT VYLQMNSLKPED TAIYYCKA | 340 EVVAGD YDY | 391 WGQGTQV TVSS |
| PMP28G3 | 86 EVQLVESGGGLVQAGGSLRLSCTASGNIFS | 137 TETMG | 188 WYRQPPG KQRDVV | 239 ATITHGGTTN YADSVKG | 290 RFTISRDNRKNT VYLQMNSLKPED TGVYYCNA | 341 RSSWYS PEY | 392 WGQGTQV TVSS |
| PMP28E11 | 87 EVQLVESGGGFVQAGGSLRLSCIASGDNFS | 138 INRMG | 189 WYRQALG KQRELVA | 240 IITNHGSTNY ADAVKG | 291 RFTISRDYAKNTV YLQMNGLKPDDT AVYYCNA | 342 YISEVGT WRDDY | 393 WGQGIQVTVSS |

TABLE A-1-continued

Preferred combinations of CDR and framework sequences.

| CLONE | ID FR1 | ID CDR1 | ID FR2 | ID CDR2 | ID FR3 | ID CDR3 | ID FR4 |
|---|---|---|---|---|---|---|---|
| 059B.IL6R.c15.7(t) | 88 EVQLVESGGGLVQAGGSLRLSCAASGRTFS | 139 GADAG | 190 WNRQTPGKEREFVA | 241 AINWSGNSTYYADSVKG | 292 RFTVSRDNAKNTVYLQMNSLKPEDTAVYYCHA | 343 FRDDYYS | 394 EGKGTLVTVSS |
| 059A.IL6Rc14(t) | 89 EVQLVESGGGLVQAGGSLRLSCAASGRTLS | 140 SYDMG | 191 WYRQGPGKEREFVA | 242 AISWSGGGTDYVDSVKG | 293 RFTISRDTAKNTMYLQMNSLKPEDTAIYYCNA | 344 LGTTDSDYEGELY | 395 WGQGTQVTVSS |
| 059A.IL6Rc13(t) | 90 EVQLVESGGGLVQPGGSLRLSCAASGFTLD | 141 SYAIG | 192 WFRQAPGKEPEGVS | 243 CISTSDGSTYYADSVKG | 294 RFTISRDNAKNTVYLQMNSLKPEDTAVYYCTA | 345 DGGPHAPLTVQDMCVMAIADY | 396 WGQGTQVTVSS |
| 059A.IL6Rc12(t) | 91 EVQLVESGGGLVQAGGSLRLSCAASGRTFS | 142 NIAMG | 193 WIREAPGKEREFVA | 244 ALTWSGGSTYYADSVKG | 295 RFTISRDSAKNTVYLQMNKLKPEDTAVYYCVA | 346 DEEIHLIVSISIADF | 397 WGQGTQVTVSS |
| 059A.IL6Rc11(t) | 92 EVQLVESGGGLVQAGGSLRLSCAASGLTDD | 143 DFAIG | 194 WFRQAPGKEPEGVS | 245 CISSSDGSTYYADSVKG | 296 RFTISSDNAKNTVYLQMNSLKPEDTAVYFCTA | 347 LFDRCGSTWYGMDY | 398 WGKGTLVTVSS |

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies®.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivates as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies can bind to serum proteins such as serum albumin (such as human serum albumin), serum immunoglobulins such as IgG, or transferrin; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins (such as, without limitation, the proteins and peptides described in WO 91/01743, WO 01/45746, WO 02/076489).

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such compounds or polypeptides of the invention have a serum half-life that is increased with more than 1 hour, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect, the invention relates to a nucleic acid that encodes an amino acid sequence of the invention or a polypeptide of the invention (or a suitable fragment thereof). Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence of the invention (or a suitable fragment thereof), at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

In another specific, but non-limiting aspect, the amino acid sequences and polypeptides described herein are such that they (a) specifically bind (as defined herein) to the IL-6 receptor; and (b) are capable of downregulating the IL-6 receptor and/or are capable of inhibiting, decreasing or downregulating the signalling of the IL-6 receptor and/or the pathway(s), mechanism(s) or signalling in which the IL-6 or IL-6R is involved. As will be clear to the skilled person, such an amino acid sequence or polypeptide can generally be used as an antagonist of IL-6, of the IL-6 receptor and/or of the biological pathways, mechanisms or effects in which IL-6, Il-6R and/or Il-6/IL-6R mediated signalling is involved. Any such decrease or downregulation (which can be at least 1%, such as at least 5%, or more than 10%, or up to 50% or 100% or more in a relevant parameter, compared to the same parameter under conditions in which the amino acid sequence or polypeptide is not bound to the IL-6 receptor), may be measured in any suitable manner known per se, for example using one of the assays used in the Experimental Part and/or mentioned herein.

For example, such antagonistic amino acid sequences and polypeptides may be competitive of non-competitive inhibitors of the binding of IL-6 to IL-6R.

More in particular, and in addition to (a) and (b) above, and optionally in addition to (d) and/or (e) below, such antagonistic amino acid sequences and polypeptides may bind to IL-6R in such a way that (c) binding of IL-6 to IL-6R is blocked, inhibited or reduced; compared to the binding of IL-6 to its receptor without the presence of the amino acid sequence or Nanobody of the invention.

For example, and without limitation, such antagonistic amino acid sequences and polypeptides may bind to or close to the IL-6 om IL-6R.

Also, in addition to (a) and (b) above, and optionally in addition to (c) above or (e) below, such antagonistic amino acid sequences and polypeptides may bind to IL-6R (i.e. as such or as present in the IL-6/IL-6R complex) in such a way that (d) the formation of the IL-6/IL-6R complex is inhibited or affected (e.g. fully or partially disrupted) in such a way that the binding of the complex to—e.g. its affinity for—gp130 is reduced (or reversely, that the binding of gp 130 to—e.g. its affinity for—the complex is reduced), so that the signaling induced/mediated by the binding of the complex to gp130 is modulated (e.g. reduced); compared to the formation of the complex and its binding to gp130 without the presence of the amino acid sequence or Nanobody of the invention.

Also, in addition to (a) and (b) above, and optionally in addition to (c) or (d) above, such antagonistic amino acid sequences and polypeptides may bind to IL-6R (i.e. as such or as present in the IL-6/IL-6R complex) in such a way that (e) binding to IL-6R (i.e. as such or as present in the IL-6/IL-6R complex) in such a way that the formation of the IL-6/IL-6R complex essentially is not affected but that the binding of said complex to gp130 is modulated (e.g. inhibited), so that the signalling induced/mediated by the binding of the complex to gp130 is modulated (e.g. reduced); compared to the formation of the complex and its binding to gp 130 without the presence of the amino acid sequence or Nanobody of the invention.

Alternatively, such antagonistic amino acid sequences and polypeptides may bind to another epitope, site, domain or region on the IL-6 receptor (e.g. allosteric binding) such that the IL-6 receptor becomes less sensitive for binding of IL-6 (and/or that the signalling of the IL-6 receptor upon binding of IL-6 is reduced).

It is also possible that such antagonistic amino acid sequences and polypeptides may bind to another epitope, site, domain or region on the IL-6 receptor such that the ligand-mediated dimerization of the growth factor receptor is prevented, reduced or inhibited.

Accordingly, in the context of the present invention, "modulating" or "to modulate" generally means exercising an agonistic or antagonistic effect, respectively, with respect to IL-6, IL-6R and/or the biological pathways, responses, signalling, mechanisms or effects in which IL-6 and/or IL-6R is involved. In particular, "modulating" or "to modulate" may mean either an such an agonistic or antagonistic effect (i.e. a full or partial agonistic or antagonistic effect, respectively), as measured using a suitable in vitro, cellular or in vivo assay (such as those mentioned herein), that leads to a change in a relevant parameter by at least 1%, preferably at least 5%, such as at least 10% or at least 25%, for example by at least 50%, at least 60%, at least 70%, at least 80%, or 90% or more, compared to same parameter in the same assay under the same conditions but without the presence of the amino acid sequence, Nanobody or polypeptide of the invention.

The invention further relates to methods for preparing or generating the amino acid sequences, polypeptides, nucleic acids, host cells, products and compositions described herein.

Some preferred but non-limiting examples of such methods will become clear from the further description herein.

Generally, these methods may comprise the steps of:
a) providing a set, collection or library of amino acid sequences; and
b) screening said set, collection or library of amino acid sequences for amino acid sequences that can bind to and/or have affinity for IL-6R; and
c) isolating the amino acid sequence(s) that can bind to and/or have affinity for IL-6R.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:
a) providing a collection or sample of cells expressing amino acid sequences;
b) screening said collection or sample of cells for cells that express an amino acid sequence that can bind to and/or have affinity for IL-6R; and
c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820.

In another aspect, the method for generating an amino acid sequence directed against IL-6R may comprise at least the steps of
a) providing a set, collection or library of nucleic acid sequences encoding amino acid sequences;
b) screening said set, collection or library of nucleic acid sequences for nucleic acid sequences that encode an amino acid sequence that can bind to and/or has affinity for IL-6R; and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with IL-6R or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

The invention also relates to amino acid sequences that are obtained by the above methods, or alternatively by a method that comprises the one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, polypeptides, nucleic acids, host cells, products and compositions described herein, as well as to methods for the prevention and/or treatment for diseases and disorders associated with IL-6R. Some preferred but non-limiting applications and uses will become clear from the further description herein.

Other aspects, embodiments, advantages and applications of the invention will also become clear from the further description herein, in which the invention will be described and discussed in more detail with reference to the Nanobodies of the invention and of polypeptides of the invention comprising the same, which form some of the preferred aspects of the invention.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

DETAILED DESCRIPTION OF THE INVENTION

The above and other aspects, embodiments and advantages of the invention will become clear from the further description hereinbelow, in which:

a) Unless indicated or defined otherwise, all terms used have their usual meaning in the art, which will be clear to the skilled person. Reference is for example made to the standard handbooks, such as Sambrook et al, "Molecular Cloning: A Laboratory Manual" (2nd. Ed.), Vols. 1-3, Cold Spring Harbor Laboratory Press (1989); F. Ausubel et al, eds., "Current protocols in molecular biology", Green Publishing and Wiley Interscience, New York (1987); Lewin, "Genes II", John Wiley & Sons, New York, N.Y., (1985); Old et al., "Principles of Gene Manipulation: An Introduction to Genetic Engineering", 2nd edition, University of California Press, Berkeley, Calif. (1981); Roitt et al., "Immunology" (6th. Ed.), Mosby/Elsevier, Edinburgh (2001); Roitt et al., Roitt's Essential Immunology, 10$^{th}$ Ed. Blackwell Publishing, UK (2001); and Janeway et al., "Immunobiology" (6th Ed.), Garland Science Publishing/Churchill Livingstone, New York (2005), as well as to the general background art cited herein;

b) Unless indicated otherwise, the term "immunoglobulin sequence"—whether used herein to refer to a heavy chain antibody or to a conventional 4-chain antibody—is used as a general term to include both the full-size antibody, the individual chains thereof, as well as all parts, domains or fragments thereof (including but not limited to antigen-binding domains or fragments such as $V_{HH}$ domains or $V_H/V_L$ domains, respectively). In addition, the term "sequence" as used herein (for example in terms like "immunoglobulin sequence", "antibody sequence", "variable domain sequence", "$V_{HH}$ sequence" or "protein sequence"), should generally be understood to include both the relevant amino acid sequence as well as nucleic acid sequences or nucleotide sequences encoding the same, unless the context requires a more limited interpretation;

c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein;

d) Amino acid residues will be indicated according to the standard three-letter or one-letter amino acid code, as mentioned in Table A-2;

TABLE A-2

| one-letter and three-letter amino acid code | | | |
|---|---|---|---|
| Nonpolar, uncharged (at pH 6.0-7.0)[3] | Alanine | Ala | A |
| | Valine | Val | V |
| | Leucine | Leu | L |
| | Isoleucine | Ile | I |
| | Phenylalanine | Phe | F |
| | Methionine[1] | Met | M |
| | Tryptophan | Trp | W |
| | Proline | Pro | P |
| Polar, uncharged (at pH 6.0-7.0) | Glycine[2] | Gly | G |
| | Serine | Ser | S |
| | Threonine | Thr | T |
| | Cysteine | Cys | C |
| | Asparagine | Asn | N |
| | Glutamine | Gln | Q |
| | Tyrosine | Tyr | Y |
| Polar, charged (at pH 6.0-7.0) | Lysine | Lys | K |
| | Arginine | Arg | R |
| | Histidine[4] | His | H |
| | Aspartate | Asp | D |
| | Glutamate | Glu | E |

Notes:
a) Sometimes also considered to be a polar uncharged amino acid.
b) Sometimes also considered to be a nonpolar uncharged amino acid.
c) As will be clear to the skilled person, the fact that an amino acid residue is referred to in this Table as being either charged or uncharged at pH 6.0 to 7.0 does not reflect in any way on the charge said amino acid residue may have at a pH lower than 6.0 and/or at a pH higher than 7.0; the amino acid residues mentioned in the Table can be either charged and/or uncharged at such a higher or lower pH, as will be clear to the skilled person.
d) As is known in the art, the charge of a His residue is greatly dependant upon even small shifts in pH, but a His residu can generally be considered essentially uncharged at a pH of about 6.5.

e) For the purposes of comparing two or more nucleotide sequences, the percentage of "sequence identity" between a first nucleotide sequence and a second nucleotide sequence may be calculated by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position).

Alternatively, the degree of sequence identity between two or more nucleotide sequences may be calculated using a known computer algorithm for sequence alignment such as NCBI Blast v2.0, using standard settings.

Some other techniques, computer algorithms and settings for determining the degree of sequence identity are for example described in WO 04/037999, EP 0 967 284, EP 1 085 089, WO 00/55318, WO 00/78972, WO 98/49185 and GB 2 357 768-A.

Usually, for the purpose of determining the percentage of "sequence identity" between two nucleotide sequences in accordance with the calculation method outlined hereinabove, the nucleotide sequence with the greatest number of nucleotides will be taken as the "first" nucleotide sequence, and the other nucleotide sequence will be taken as the "second" nucleotide sequence;

f) For the purposes of comparing two or more amino acid sequences, the percentage of "sequence identity" between a first amino acid sequence and a second amino acid sequence (as referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein.

Alternatively, the degree of sequence identity between two amino acid sequences may be calculated using a known computer algorithm, such as those mentioned above for determining the degree of sequence identity for nucleotide sequences, again using standard settings.

Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.

Also, in determining the degree of sequence identity between two amino acid sequences, the skilled person may take into account so-called "conservative" amino acid substitutions, which can generally be described as amino acid substitutions in which an amino acid residue is replaced with another amino acid residue of similar chemical structure and which has little or essentially no influence on the function, activity or other biological properties of the polypeptide. Such conservative amino acid substitutions are well known in the art, for example from WO 04/037999, GB-A-3 357 768, WO 98/49185, WO 00/46383 and WO 01/09300; and (preferred) types and/or combinations of such substitutions may be selected on the basis of the pertinent teachings from WO 04/037999 as well as WO 98/49185 and from the further references cited therein.

Such conservative substitutions preferably are substitutions in which one amino acid within the following groups (a)-(e) is substituted by another amino acid residue within the same group: (a) small aliphatic, nonpolar or slightly polar residues: Ala, Ser, Thr, Pro and Gly; (b) polar, negatively charged residues and their (uncharged) amides: Asp, Asn, Glu and Gln; (c) polar, positively charged residues: His, Arg and Lys; (d) large aliphatic, nonpolar residues: Met, Leu, Ile, Val and Cys; and (e) aromatic residues: Phe, Tyr and Trp.

Particularly preferred conservative substitutions are as follows: Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Nad. Acad. Sci. USA 81: 140-144, 1984; Kyte & Doolittle; J Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length;

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences;

i) When a nucleotide sequence or amino acid sequence is said to "comprise" another nucleotide sequence or amino acid sequence, respectively, or to "essentially consist of" another nucleotide sequence or amino acid sequence, this may mean that the latter nucleotide sequence or amino acid sequence has been incorporated into the firstmentioned nucleotide sequence or amino acid sequence, respectively, but more usually this generally means that the firstmentioned nucleotide sequence or amino acid sequence comprises within its sequence a stretch of nucleotides or amino acid residues, respectively, that has the same nucleotide sequence or amino acid sequence, respectively, as the latter sequence, irrespective of how the firstmentioned sequence has actually been generated or obtained (which may for example be by any suitable method described herein). By means of a non-limiting example, when a Nanobody of the invention is said to comprise a CDR sequence, this may mean that said CDR sequence has been incorporated into the Nanobody of the invention, but more usually this generally means that the Nanobody of the invention contains within its sequence a stretch of amino acid residues with the same amino acid sequence as said CDR sequence, irrespective of how said Nanobody of the invention has been generated or obtained. It should also be noted that when the latter amino acid sequence has a specific biological or structural function, it preferably has essentially the same, a similar or an equivalent biological or structural function in the firstmentioned amino acid sequence (in other words, the firstmentioned amino acid sequence is preferably such that the latter sequence is capable of performing essentially the same, a similar or an equivalent biological or structural function). For example, when a Nanobody of the invention is said to comprise a CDR sequence or framework sequence, respectively, the CDR sequence and framework are preferably capable, in said Nanobody, of functioning as a CDR sequence or framework sequence, respectively. Also, when a nucleotide sequence is said to comprise another nucleotide sequence, the firstmentioned nucleotide sequence is preferably such that, when it is expressed into an expression product (e.g. a polypeptide), the amino acid sequence encoded by the latter nucleotide sequence forms part of said expression product (in other words, that the latter nucleotide sequence is in the same reading frame as the firstmentioned, larger nucleotide sequence).

j) A nucleic acid sequence or amino acid sequence is considered to be "(in) essentially isolated (form)"—for example, compared to its native biological source and/or the reaction medium or cultivation medium from which it has been obtained—when it has been separated from at least one other component with which it is usually associated in said source or medium, such as another nucleic acid, another protein/polypeptide, another biological component or macromolecule or at least one contaminant, impurity or minor component. In particular, a nucleic acid sequence or amino acid sequence is considered "essentially isolated" when it has been purified at least 2-fold, in particular at least 10-fold, more in particular at least 100-fold, and up to 1000-fold or more. A nucleic acid sequence or amino acid sequence that is "in essentially isolated form" is preferably essentially homogeneous, as determined using a suitable technique, such as a suitable chromatographical technique, such as polyacrylamide-gel electrophoresis;

k) The term "domain" as used herein generally refers to a globular region of an antibody chain, and in particular to a globular region of a heavy chain antibody, or to a polypeptide that essentially consists of such a globular region. Usually, such a domain will comprise peptide loops (for example 3 or 4 peptide loops) stabilized, for example, as a sheet or by disulfide bonds.

l) The term 'antigenic determinant' refers to the epitope on the antigen recognized by the antigen-binding molecule (such as a Nanobody or a polypeptide of the invention) and more in particular by the antigen-binding site of said molecule. The terms "antigenic determinant" and "epitope' may also be used interchangeably herein.

m) An amino acid sequence (such as a Nanobody, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein. In particular, an amino acid sequence that "against" or "directed against" an antigenic determinant, epitope, antigen or protein (or for at least one part, fragment or epitope thereof) and/or that can specifically bind to, that has affinity for and/or that has specificity for a specific antigenic determinant, epitope, antigen or protein (or for at least one part, fragment or epitope thereof) is defined herein as an amino acid sequence that can bind to said antigenic determinant, epitope, antigen or protein (or for at least one part, fragment or epitope thereof) with a dissociation constant ($K_D$) of $10^{-5}$ to $10^{42}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles).

n) The term "specificity" refers to the number of different types of antigens or antigenic determinants to which a particular antigen-binding molecule or antigen-binding protein (such as a Nanobody or a polypeptide of the invention) molecule can bind. The specificity of an antigen-binding protein can be determined based on affinity and/or avidity. The affinity, represented by the equilibrium constant for the dissociation of an antigen with an antigen-binding protein ($K_D$), is a measure for the binding strength between an antigenic determinant and an antigen-binding site on the antigen-binding protein: the lesser the value of the $K_D$, the stronger the binding strength between an antigenic determinant and the antigen-binding molecule (alternatively, the affinity can also be expressed as the affinity constant ($K_A$), which is $1/K_D$). As will be clear to the skilled person (for example on the basis of the further disclosure herein), affinity can be determined in a manner known per se, depending on the specific antigen of interest. Avidity is the measure of the strength of binding between an antigen-binding molecule (such as a Nanobody or polypeptide of the invention) and the pertinent antigen. Avidity is related to both the affinity between an antigenic determinant and its antigen binding site on the antigen-binding molecule and the number of pertinent binding sites present on the antigen-binding molecule. Typically, antigen-binding proteins (such as the amino acid sequences, Nanobodies and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4 M^{-1}$) liters/mol is generally considered to indicate non-specific binding. Preferably, a monovalent immunoglobulin sequence of the invention will bind to the desired serum protein with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein.

The dissociation constant may be the actual or apparent dissociation constant, as will be clear to the skilled person. Methods for determining the dissociation constant will be clear to the skilled person, and for example include the techniques mentioned herein. In this respect, it will also be clear that it may not be possible to measure dissociation constants of more then $10^4$ moles/liter or $10^3$ moles/liter (e.g. of $10^2$ moles/liter). Optionally, as will also be clear to the skilled person, the (actual or apparent) dissociation constant may be calculated on the basis of the (actual or apparent) association constant ($K_A$), by means of the relationship [$K_D=1/K_A$].

The affinity denotes the strength or stability of a molecular interaction. The affinity is commonly given as by the $K_D$, or dissociation constant, which has units of mol/liter (or M). The affinity can also be expressed as an association constant, $K_A$, which equals $1/K_D$ and has units of (mol/liter)$^{-1}$ (or M$^{-1}$). In the present specification, the stability of the interaction between two molecules (such as an amino acid sequence, Nanobody or polypeptide of the invention and its intended target) will mainly be expressed in terms of the $K_D$ value of their interaction; it being clear to the skilled person that in view of the relation $K_A=1/K_D$, specifying the strength of molecular interaction by its $K_D$ value can also be used to calculate the corresponding $K_A$ value. The $K_D$-value characterizes the strength of a molecular interaction also in a thermodynamic sense as it is related to the free energy (DG) of binding by the well known relation DG=RT·ln($K_D$) (equivalently DG=–RT·ln($K_A$)), where R equals the gas constant, T equals the absolute temperature and ln denotes the natural logarithm.

The $K_D$ for biological interactions which are considered meaningful (e.g. specific) are typically in the range of $10^{-10}$M (0.1 nM) to $10^{-5}$M (10000 nM). The stronger an interaction is, the lower is its $K_D$.

The $K_D$ can also be expressed as the ratio of the dissociation rate constant of a complex, denoted as $k_{off}$, to the rate of its association, denoted $k_{on}$ (so that $K_D=k_{off}/k_{on}$ and $K_A=k_{on}/k_{off}$). The off-rate $k_{off}$ has units s$^{-1}$ (where s is the SI unit notation of second). The on-rate $k_{on}$ has units M$^{-1}$s$^{-1}$. The on-rate may vary between $10^2$ M$^{-1}$s$^{-1}$ to about $10^7$ M$^{-1}$s$^{-1}$, approaching the diffusion-limited association rate constant for bimolecular interactions. The off-rate is related to the half-life of a given molecular interaction by the relation $t_{1/2}=\ln(2)/k_{off}$. The off-rate may vary between $10^{-6}$ s–1 (near irreversible complex with a $t_{1/2}$ of multiple days) to 1 s$^{-1}$ ($t_{1/2}=0.69$ s).

The affinity of a molecular interaction between two molecules can be measured via different techniques known per se, such as the well the known surface plasmon resonance (SPR) biosensor technique (see for example Ober et al., Intern. Immunology, 13, 1551-1559, 2001) where one molecule is immobilized on the biosensor chip and the other molecule is passed over the immobilized molecule under flow conditions yielding $k_{on}$, $k_{off}$ measurements and hence $K_D$ (or $K_A$) values. This can for example be performed using the well-known BIACORE instruments.

It will also be clear to the skilled person that the measured $K_D$ may correspond to the apparent $K_D$ if the measuring process somehow influences the intrinsic binding affinity of the implied molecules for example by artifacts related to the coating on the biosensor of one molecule. Also, an apparent $K_D$ may be measured if one molecule contains more than one recognition sites for the other molecule. In such situation the measured affinity may be affected by the avidity of the interaction by the two molecules.

Another approach that may be used to assess affinity is the 2-step ELISA (Enzyme, Linked Immunosorbent Assay) procedure of Friguet et al. (J. Immunol. Methods, 77, 305-19, 1985). This method establishes a solution phase binding equilibrium measurement and avoids possible artifacts relating to adsorption of one of the molecules on a support such as plastic.

However, the accurate measurement of $K_D$ may be quite labor-intensive and as consequence, often apparent $K_D$ values are determined to assess the binding strength of two molecules. It should be noted that as long all measurements are made in a consistent way (e.g. keeping the assay conditions unchanged) apparent $K_D$ measurements can be used as an approximation of the true $K_D$ and hence in the present document $K_D$ and apparent $K_D$ should be treated with equal importance or relevance.

Finally, it should be noted that in many situations the experienced scientist may judge it to be convenient to determine the binding affinity relative to some reference molecule. For example, to assess the binding strength between molecules A and B, one may e.g. use a reference molecule C that is known to bind to B and that is suitably labeled with a fluorophore or chromophore group or other chemical moiety, such as biotin for easy detection in an ELISA or FACS (Fluorescent activated cell sorting) or other format (the fluorophore for fluorescence detection, the chromophore for light absorption detection, the biotin for streptavidin-mediated ELISA detection). Typically, the reference molecule C is kept at a fixed concentration and the concentration of A is varied for a given concentration or amount of B. As a result an IC$_{50}$ value is obtained corresponding to the concentration of A at which the signal measured for C in absence of A is halved. Provided $K_{D\ ref}$, the $K_D$ of the reference molecule, is known, as well as the total concentration $c_{ref}$ of the reference molecule, the apparent $K_D$ for the interaction A-B can be obtained from following formula: $K_D=IC_{50}/(1+c_{ref}/K_{D\ ref})$. Note that if cref<<$K_D$ ref, $K_D \approx IC_{50}$. Provided the measurement of the IC$_{50}$ is performed in a consistent way (e.g. keeping $c_{ref}$ fixed) for the binders that are compared, the strength or stability of a molecular interaction can be assessed by the IC$_{50}$ and this measurement is judged as equivalent to $K_D$ or to apparent $K_D$ throughout this text.

o) The half-life of an amino acid sequence, compound or polypeptide of the invention can generally be defined as the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally involve the steps of suitably administering to a warm-blooded animal (i.e. to a human or to another suitable mammal, such as a mouse, rabbit, rat, pig, dog or a primate, for example monkeys from the genus *Macaca* (such as, and in particular, cynomolgus monkeys (*Macaca fascicularis*) and/or rhesus monkeys (*Macaca mulatta*)) and baboon (*Papio ursinus*)) a suitable dose of the amino acid sequence, compound or polypeptide of the invention; collecting blood samples or other samples from said animal; determining the level or concentration of the amino acid sequence, compound or polypeptide of the invention in said blood sample; and calculating, from (a plot of) the data thus obtained, the time until the level or concentration of the amino acid sequence, compound or polypeptide of the invention has been reduced by 50% compared to the initial level upon dosing. Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982).

As will also be clear to the skilled person (see for example pages 6 and 7 of WO 04/003019 and in the further references cited therein), the half-life can be expressed using parameters such as the t½-alpha, t½-beta and the area under the curve (AUC). In the present specification, an "increase in half-life" refers to an increase in any one of these parameters, such as any two of these parameters, or essentially all three these parameters. As used herein "increase in half-life" or "increased half-life" in particular refers to an increase in the t½-beta, either with or without an increase in the t½-alpha and/or the AUC or both.

p) As also further described herein, the total number of amino acid residues in a Nanobody can be in the region of 110-120, is preferably 112-115, and is most preferably 113. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

q) The amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2):185-195 (see for example FIG. 2 of said article or referred to herein. According to this numbering, FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113. [In this respect, it should be noted that—as is well known in the art for $V_H$ domains and for $V_{HH}$ domains—the total number of amino acid residues in each of the CDR's may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. Generally, however, it can be said that, according to the numbering of Kabat and irrespective of the number of amino acid residues in the CDR's, position 1 according to the Kabat numbering corresponds to the start of FR1 and vice versa, position 36 according to the Kabat numbering corresponds to the start of FR2 and vice versa, position 66 according to the Kabat numbering corresponds to the start of FR3 and vice versa, and position 103 according to the Kabat numbering corresponds to the start of FR4 and vice versa.]. Alternative methods for numbering the amino acid residues of $V_H$ domains, which methods can also be applied in an analogous manner to $V_{HH}$ domains from Camelids and to Nanobodies, are the method described by Chothia et al. (Nature 342, 877-883 (1989)), the so-called "AbM definition" and the so-called "contact definition". However, in the present description, claims and figures, the numbering according to Kabat as applied to $V_{HH}$ domains by Riechmann and Muyldermans will be followed, unless indicated otherwise; and r) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, to the review article by Muyldermans in Reviews in Molecular Biotechnology 74 (2001), 277-302; as well as to the following patent applications, which are mentioned as general background art: WO 94/04678, WO 95/04079 and WO 96/34103 of the Vrije Universiteit Brussel; WO 94/25591, WO 99/37681, WO 00/40968, WO 00/43507, WO 00/65057, WO 01/40310, WO 01/44301, EP 1134231 and WO 02/48193 of Unilever; WO 97/49805, WO 01/21817, WO 03/035694, WO 03/054016 and WO 03/055527 of the Vlaams Instituut voor Biotechnologie (VIB); WO 03/050531 of Algonomics N.V. and Ablynx N.V.; WO 01/90190 by the National Research Council of Canada; WO 03/025020 (=EP 1 433 793) by the Institute of Antibodies; as well as WO 04/041867, WO 04/041862, WO 04/041865, WO 04/041863, WO 04/062551, WO 05/044858, WO 06/40153, WO 06/079372, WO 06/122786, WO 06/122787 and WO 06/122825, by Ablynx N.V. and the further published patent applications by Ablynx N.V. Reference is also made to the further prior art mentioned in these applications, and in particular to the list of references mentioned on pages 41-43 of the International application WO 06/040153, which list and references are incorporated herein by reference.

In accordance with the terminology used in the above references, the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments):

- only a single domain is required to bind an antigen with high affinity and with high selectivity, so that there is no need to have two separate domains present, nor to assure that these two domains are present in the right spacial conformation and configuration (i.e. through the use of especially designed linkers, as with scFv's);
- $V_{HH}$ domains and Nanobodies can be expressed from a single gene and require no post-translational folding or modifications;
- $V_{HH}$ domains and Nanobodies can easily be engineered into multivalent and multispecific formats (as further discussed herein);
- $V_{HH}$ domains and Nanobodies are highly soluble and do not have a tendency to aggregate (as with the mouse-derived antigen-binding domains described by Ward et al., Nature, Vol. 341, 1989, p. 544);
- $V_{HH}$ domains and Nanobodies are highly stable to heat, pH, proteases and other denaturing agents or conditions (see for example Ewert et al, supra);
- $V_{HH}$ domains and Nanobodies are easy and relatively cheap to prepare, even on a scale required for production. For example, $V_{HH}$ domains, Nanobodies and proteins/polypeptides containing the same can be produced using microbial fermentation (e.g. as further described below) and do not require the use of mammalian expression systems, as with for example conventional antibody fragments;
- $V_{HH}$ domains and Nanobodies are relatively small (approximately 15 kDa, or 10 times smaller than a conventional IgG) compared to conventional 4-chain antibodies and antigen-binding fragments thereof, and therefore show high(er) penetration into tissues (including but not limited to solid tumors and other dense tissues) than such conventional 4-chain antibodies and antigen-binding fragments thereof;
- $V_{HH}$ domains and Nanobodies can show so-called cavity-binding properties (inter alia due to their extended CDR3 loop, compared to conventional $V_H$ domains) and can therefore also access targets and epitopes not accessible to conventional 4-chain antibodies and antigen-binding fragments thereof. For example, it has been shown that $V_{HH}$ domains and Nanobodies can inhibit enzymes (see for example WO 97/49805; Transue et al., (1998), supra; Lauwereys et al., (1998), supra.

As mentioned above, the invention generally relates to Nanobodies directed against the IL-6 receptor, as well as to polypeptides comprising or essentially consisting of one or more of such Nanobodies, that can be used for the prophylactic, therapeutic and/or diagnostic purposes described herein.

As also further described herein, the invention further relates to nucleic acids encoding such Nanobodies and polypeptides, to methods for preparing such Nanobodies and polypeptides, to host cells expressing or capable of expressing such Nanobodies or polypeptides, to compositions comprising such Nanobodies, polypeptides, nucleic acids or host cells, and to uses of such Nanobodies, polypeptides, nucleic acids, host cells or compositions.

Generally, it should be noted that the term Nanobody as used herein in its broadest sense is not limited to a specific biological source or to a specific method of preparation. For example, as will be discussed in more detail below, the Nanobodies of the invention can generally be obtained: (1) by isolating the $V_{HH}$ domain of a naturally occurring heavy chain antibody; (2) by expression of a nucleotide sequence encoding a naturally occurring $V_{HH}$ domain; (3) by "humanization" (as described herein) of a naturally occurring $V_{HH}$ domain or by expression of a nucleic acid encoding a such humanized $V_{HH}$ domain; (4) by "camelization" (as described herein) of a naturally occurring $V_H$ domain from any animal species, and in particular a from species of mammal, such as from a human being, or by expression of a nucleic acid encoding such a camelized $V_H$ domain; (5) by "camelisation" of a "domain antibody" or "Dab" as described by Ward et al (supra), or by expression of a nucleic acid encoding such a camelized $V_H$ domain; (6) by using synthetic or semi-synthetic techniques for preparing proteins, polypeptides or other amino acid sequences known per se; (7) by preparing a nucleic acid encoding a Nanobody using techniques for nucleic acid synthesis known per se, followed by expression of the nucleic acid thus obtained; and/or (8) by any combination of one or more of the foregoing. Suitable methods and techniques for performing the foregoing will be clear to the skilled person based on the disclosure herein and for example include the methods and techniques described in more detail herein.

One preferred class of Nanobodies corresponds to the $V_{HH}$ domains of naturally occurring heavy chain antibodies directed against the IL-6 receptor. As further described herein, such $V_{HH}$ sequences can generally be generated or obtained by suitably immunizing a species of Camelid with the IL-6 receptor (i.e. so as to raise an immune response and/or heavy chain antibodies directed against the IL-6 receptor), by obtaining a suitable biological sample from said Camelid (such as a blood sample, serum sample or sample of B-cells), and by generating $V_{HH}$ sequences directed against the IL-6 receptor, starting from said sample, using any suitable technique known per se. Such techniques will be clear to the skilled person and/or are further described herein.

Alternatively, such naturally occurring $V_{HH}$ domains against the IL-6 receptor, can be obtained from naïve libraries of Camelid $V_{HH}$ sequences, for example by screening such a library using the IL-6 receptor, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Yet another technique for obtaining $V_{HH}$ sequences directed against the IL-6 receptor, involves suitably immunizing a transgenic mammal that is capable of expressing heavy chain antibodies (i.e. so as to raise an immune response and/or heavy chain antibodies directed against the IL-6 receptor), obtaining a suitable biological sample from said transgenic mammal (such as a blood sample, serum sample or sample of B-cells), and then generating $V_{HH}$ sequences directed against The IL-6 receptor, starting from said sample, using any suitable technique known per se. For example, for this purpose, the heavy chain antibody-expressing mice and the further methods and techniques described in WO 02/085945, WO 04/049794, WO 06/008548 and Janssens et al., Proc. Natl. Acad. Sci. USA. 2006 Oct. 10; 103(41):15130-5 can be used.

A particularly preferred class of Nanobodies of the invention comprises Nanobodies with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above). This can be performed in a manner known per se, which will be clear to the skilled person, for example on the basis of the further description herein and the prior art on humanization referred to herein. Again, it should be noted that such humanized Nanobodies of the invention can be obtained in any suitable manner known per se (i.e. as indicated under points (1)-(8) above) and thus are not strictly limited to polypeptides that have been obtained using a polypeptide that comprises a naturally occurring $V_{HH}$ domain as a starting material.

Another particularly preferred class of Nanobodies of the invention comprises Nanobodies with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody. This can be performed in a manner known per se, which will be clear to the skilled person, for example on the basis of the further description herein. Such "camelizing" substitutions are preferably inserted at amino acid positions that form and/or are present at the $V_H$-$V_L$ interface, and/or at the so-called Camelidae hallmark residues, as defined herein (see for example WO 94/04678 and Davies and Riechmann (1994 and 1996), supra). Preferably, the $V_H$ sequence that is used as a starting material or starting point for generating or designing the camelized Nanobody is preferably a $V_H$ sequence from a mammal, more preferably the $V_H$ sequence of a human being, such as a $V_H3$ sequence. However, it should be noted that such camelized Nanobodies of the invention can be obtained in any suitable manner known per se (i.e. as indicated under points (1)-(8) above) and thus are not strictly limited to polypeptides that have been obtained using a polypeptide that comprises a naturally occurring $V_H$ domain as a starting material.

For example, again as further described herein, both "humanization" and "camelization" can be performed by providing a nucleotide sequence that encodes a naturally occurring $V_{HH}$ domain or $V_H$ domain, respectively, and then changing, in a manner known per se, one or more codons in said nucleotide sequence in such a way that the new nucleotide sequence encodes a "humanized" or "camelized" Nanobody of the invention, respectively. This nucleic acid can then be expressed in a manner known per se, so as to provide the desired Nanobody of the invention. Alternatively, based on the amino acid sequence of a naturally occurring $V_{HH}$ domain or $V_H$ domain, respectively, the amino acid sequence of the desired humanized or camelized Nanobody of the invention, respectively, can be designed and then synthesized de novo using techniques for peptide synthesis known per se. Also, based on the amino acid sequence or nucleotide sequence of a naturally occurring $V_{HH}$ domain or $V_H$ domain, respectively, a nucleotide sequence encoding the desired humanized or camelized Nanobody of the invention, respectively, can be designed and then synthesized de novo using techniques for nucleic acid synthesis known per se, after which the nucleic acid thus obtained can be expressed in a manner known per se, so as to provide the desired Nanobody of the invention.

Other suitable methods and techniques for obtaining the Nanobodies of the invention and/or nucleic acids encoding the same, starting from naturally occurring $V_H$ sequences or preferably $V_{HH}$ sequences, will be clear from the skilled person, and may for example comprise combining one or more parts of one or more naturally occurring $V_H$ sequences (such as one or more FR sequences and/or CDR sequences), one or more parts of one or more naturally occurring $V_{HH}$ sequences (such as one or more FR sequences or CDR sequences), and/or one or more synthetic or semi-synthetic sequences, in a suitable manner, so as to provide a Nanobody of the invention or a nucleotide sequence or nucleic acid encoding the same.

Optionally, a Nanobody of the invention may also, and in addition to the at least one binding site for binding against IL-6R, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130; WO 06/07260 and the US provisional application by Ablynx N.V. entitled "Immunoglobulin domains with multiple binding sites" filed on Nov. 27, 2006.

According to one preferred, but non-limiting aspect of the invention, a Nanobody in its broadest sense can be generally defined as a polypeptide comprising:
a) an amino acid sequence that is comprised of four framework regions/sequences interrupted by three complementarity determining regions/sequences, in which the amino acid residue at position 108 according to the Kabat numbering is Q;
and/or:
b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;
and/or:
c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, in a first preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 45 according to the Kabat numbering is a charged amino acid or a cysteine and the amino acid residue at position 44 according to the Kabat numbering is preferably E;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred embodiments herein, and are more preferably as defined according to one of the more preferred embodiments herein.

In particular, a Nanobody in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, according to a preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred embodiments herein, and are more preferably as defined according to one of the more preferred embodiments herein.

In particular, a Nanobody against the IL-6 receptor, according to the invention may have the structure:

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred embodiments herein, and are more preferably as defined according to one of the more preferred embodiments herein.

In particular, according to one preferred, but non-limiting aspect of the invention, a Nanobody can generally be defined as a polypeptide comprising an amino acid sequence that is comprised of four framework regions/sequences interrupted by three complementarity determining regions/sequences, in which;

a-1) the amino acid residue at position 44 according to the Kabat numbering is chosen from the group consisting of A, G, E, D, G, Q, R, S, L; and is preferably chosen from the group consisting of G, E or Q; and a-2) the amino acid residue at position 45 according to the Kabat numbering is chosen from the group consisting of L, R or C; and is preferably chosen from the group consisting of L or R; and a-3) the amino acid residue at position 103 according to the Kabat numbering is chosen from the group consisting of W, R or S; and is preferably W or R, and is most preferably W;

a-4) the amino acid residue at position 108 according to the Kabat numbering is Q;

or in which:

b-1) the amino acid residue at position 44 according to the Kabat numbering is chosen from the group consisting of E and Q; and b-2) the amino acid residue at position 45 according to the Kabat numbering is R; and b-3) the amino acid residue at position 103 according to the Kabat numbering is chosen from the group consisting of W, R and S; and is preferably W;

b-4) the amino acid residue at position 108 according to the Kabat numbering is chosen from the group consisting of Q and L; and is preferably Q;

or in which:

c-1) the amino acid residue at position 44 according to the Kabat numbering is chosen from the group consisting of A, G, E, D, Q, R, S and L; and is preferably chosen from the group consisting of G, E and Q; and c-2) the amino acid residue at position 45 according to the Kabat numbering is chosen from the group consisting of L, R and C; and is preferably chosen from the group consisting of L and R; and c-3) the amino acid residue at position 103 according to the Kabat numbering is chosen from the group consisting of P, R and S; and is in particular chosen from the group consisting of R and S; and c-4) the amino acid residue at position 108 according to the Kabat numbering is chosen from the group consisting of Q and L; is preferably Q;
and in which
d) CDR1, CDR2 and CDR3 are as defined herein, and are preferably as defined according to one of the preferred embodiments herein, and are more preferably as defined according to one of the more preferred embodiments herein.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
a-1) the amino acid residue at position 44 according to the Kabat numbering is chosen from the group consisting of A, G, E, D, G, Q, R, S, L; and is preferably chosen from the group consisting of G, E or Q;
and in which:
a-2) the amino acid residue at position 45 according to the Kabat numbering is chosen from the group consisting of L, R or C; and is preferably chosen from the group consisting of L or R;
and in which:
a-3) the amino acid residue at position 103 according to the Kabat numbering is chosen from the group consisting of W, R or S; and is preferably W or R, and is most preferably W; and in which
a-4) the amino acid residue at position 108 according to the Kabat numbering is Q;
and in which:
d) CDR1, CDR2 and CDR3 are as defined herein, and are preferably as defined according to one of the preferred embodiments herein, and are more preferably as defined according to one of the more preferred embodiments herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
b-1) the amino acid residue at position 44 according to the Kabat numbering is chosen from the group consisting of E and Q;
and in which:
b-2) the amino acid residue at position 45 according to the Kabat numbering is R;
and in which:
b-3) the amino acid residue at position 103 according to the Kabat numbering is chosen from the group consisting of W, R and S; and is preferably W;
and in which:
b-4) the amino acid residue at position 108 according to the Kabat numbering is chosen from the group consisting of Q and L; and is preferably Q;
and in which:
d) CDR1, CDR2 and CDR3 are as defined herein, and are preferably as defined according to one of the preferred embodiments herein, and are more preferably as defined according to one of the more preferred embodiments herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
c-1) the amino acid residue at position 44 according to the Kabat numbering is chosen from the group consisting of A, G, E, D, Q, R, S and L; and is preferably chosen from the group consisting of G, E and Q;
and in which:
c-2) the amino acid residue at position 45 according to the Kabat numbering is chosen from the group consisting of L, R and C; and is preferably chosen from the group consisting of L and R;
and in which:
c-3) the amino acid residue at position 103 according to the Kabat numbering is chosen from the group consisting of P, R and S; and is in particular chosen from the group consisting of R and S;
and in which:
c-4) the amino acid residue at position 108 according to the Kabat numbering is chosen from the group consisting of Q and L; is preferably Q;
and in which:
d) CDR1, CDR2 and CDR3 are as defined herein, and are preferably as defined according to one of the preferred embodiments herein, and are more preferably as defined according to one of the more preferred embodiments herein.

Two particularly preferred, but non-limiting groups of the Nanobodies of the invention are those according to a) above; according to (a-1) to (a-5) above; according to b) above; according to (b-1) to (b-4) above; according to (c) above; and/or according to (c-1) to (c-4) above, in which;
a) the amino acid residues at positions 44-47 according to the Kabat numbering form the sequence GLEW (or a GLEW-like sequence as defined herein) and the amino acid residue at position 108 is Q; or in which:
b) the amino acid residues at positions 43-46 according to the Kabat numbering form the sequence KERE or KQRE (or a KERE-like sequence) and the amino acid residue at position 108 is Q or L, and is preferably Q.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
a) the amino acid residues at positions 44-47 according to the Kabat numbering form the sequence GLEW (or a GLEW-like sequence as defined herein) and the amino acid residue at position 108 is Q;
and in which:
b) CDR1, CDR2 and CDR3 are as defined herein, and are preferably as defined according to one of the preferred embodiments herein, and are more preferably as defined according to one of the more preferred embodiments herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
a) the amino acid residues at positions 43-46 according to the Kabat numbering form the sequence KERE or KQRE (or a KERE-like sequence) and the amino acid residue at position 108 is Q or L, and is preferably Q;
and in which:
b) CDR1, CDR2 and CDR3 are as defined herein, and are preferably as defined according to one of the preferred embodiments herein, and are more preferably as defined according to one of the more preferred embodiments herein.

In the Nanobodies of the invention in which the amino acid residues at positions 43-46 according to the Kabat numbering form the sequence KERE or KQRE, the amino acid residue at position 37 is most preferably F. In the Nanobodies of the invention in which the amino acid residues at positions 44-47 according to the Kabat numbering form the sequence GLEW, the amino acid residue at position 37 is chosen from the group consisting of Y, H, I, L, V or F, and is most preferably V.

Thus, without being limited hereto in any way, on the basis of the amino acid residues present on the positions mentioned above, the Nanobodies of the invention can generally be classified on the basis of the following three groups:
a) The "GLEW-group": Nanobodies with the amino acid sequence GLEW at positions 44-47 according to the Kabat numbering and Q at position 108 according to the Kabat numbering. As further described herein, Nanobodies within this group usually have a V at position 37, and can have a W, P, R or S at position 103, and preferably have a W at position 103. The GLEW group also comprises some GLEW-like sequences such as those mentioned in Table A-3 below;
b) The "KERE-group": Nanobodies with the amino acid sequence KERE or KQRE (or another KERE-like sequence) at positions 43-46 according to the Kabat numbering and Q or L at position 108 according to the Kabat numbering. As further described herein, Nanobodies within this group usually have a F at position 37, an L or F at position 47; and can have a W, P, R or S at position 103, and preferably have a W at position 103;
c) The "103 P, R, S-group": Nanobodies with a P, R or S at position 103. These Nanobodies can have either the amino acid sequence GLEW at positions 44-47 according to the Kabat numbering or the amino acid sequence KERE or KQRE at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, Nanobodies may belong to (i.e. have characteristics of) two or more of these classes. For example, one specifically preferred group of Nanobodies has GLEW or a GLEW-like sequence at positions 44-47; P, R or S (and in particular R) at position 103; and Q at position 108 (which may be humanized to 108L).

Thus, in another preferred, but non-limiting aspect, a Nanobody of the invention may be a Nanobody belonging to the GLEW-group (as defined herein), and in which CDR1, CDR2 and CDR3 are as defined herein, and are preferably as defined according to one of the preferred embodiments herein, and are more preferably as defined according to one of the more preferred embodiments herein.

In another preferred, but non-limiting aspect, a Nanobody of the invention may be a Nanobody belonging to the KERE-group (as defined herein), and CDR1, CDR2 and CDR3 are as defined herein, and are preferably as defined according to one of the preferred embodiments herein, and are more preferably as defined according to one of the more preferred embodiments herein.

Thus, in another preferred, but non-limiting aspect, a Nanobody of the invention may be a Nanobody belonging to the 103 P, R, S-group (as defined herein), and in which CDR1, CDR2 and CDR3 are as defined herein, and are preferably as defined according to one of the preferred embodiments herein, and are more preferably as defined according to one of the more preferred embodiments herein.

Also, more generally and in addition to the 108Q, 43E/44R and 103P, R, S residues mentioned above, the Nanobodies of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2). Such substitutions include, but are not limited to, the GLEW-like sequences mentioned in Table A-3 below; as well as the substitutions that are described in the International Application WO 00/29004 for so-called "microbodies", e.g. so as to obtain a Nanobody with Q at position 108 in combination with KLEW at positions 44-47. Other possible substitutions at these positions will be clear to the skilled person based upon the disclosure herein.

In one embodiment of the Nanobodies of the invention, the amino acid residue at position 83 is chosen from the group consisting of L, M, S, V and W; and is preferably L.

Also, in one embodiment of the Nanobodies of the invention, the amino acid residue at position 83 is chosen from the group consisting of R, K, N, E, G, I, T and Q; and is most preferably either K or E (for Nanobodies corresponding to naturally occurring $V_{HH}$ domains) or R (for "humanized" Nanobodies, as described herein). The amino acid residue at position 84 is chosen from the group consisting of P, A, R, S, D T, and V in one embodiment, and is most preferably P (for Nanobodies corresponding to naturally occurring $V_{HH}$ domains) or R (for "humanized" Nanobodies, as described herein).

Furthermore, in one embodiment of the Nanobodies of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the Nanobodies are as mentioned above, will also be referred to herein as the "Hallmark Residues". The Hallmark Residues and the amino acid residues at the corresponding positions of the most closely related human $V_H$ domain, $V_H3$, are summarized in Table A-3.

Some especially preferred but non-limiting combinations of these Hallmark Residues as occur in naturally occurring $V_{HH}$ domains are mentioned in Table A-4. For comparison, the corresponding amino acid residues of the human $V_H3$ called DP-47 have been indicated in italics.

TABLE A-3

Hallmark Residues in Nanobodies

| Position | Human $V_H3$ | Hallmark Residues |
|---|---|---|
| 11 | L, V; predominantly L | L, M, S, V, W; preferably L |
| 37 | V, I, F; usually V | F(1), Y, H, I, L or V, preferably F(1) or Y |

TABLE A-3-continued

Hallmark Residues in Nanobodies

| Position | Human $V_H3$ | Hallmark Residues |
|---|---|---|
| 44[8] | G | G[2], E[3], A, D, Q, R, S, L; preferably G[2], E[3] or Q; most preferably G[2] or E[3]. |
| 45[8] | L | L[2], R[3], C, I, L, P, Q, V; preferably L[2] or R[3] |
| 47[8] | W, Y | W[2], L[1] or F[1], A, G, I, M, R, S, V or Y; preferably W[2], L[1], F[1] or R |
| 83 | R or K; usually R | R, K[5], N, E[5], G, I, M, Q or T; preferably K or R; most preferably K |
| 84 | A, T, D; predominantly A | P[5], A, L, R, S, T, D, V; preferably P |
| 103 | W | W[4], P[6], R[6], S; preferably W |
| 104 | G | G or D; preferably G |
| 108 | L, M or T; predominantly L | Q, L[7] or R; preferably Q or L[7] |

Notes:
a) In particular, but not exclusively, in combination with KERE or KQRE at positions 43-46.
b) Usually as GLEW at positions 44-47.
c) Usually as KERE or KQRE at positions 43-46, e.g. as KEREL, KEREF, KQREL, KQREF or KEREG at positions 43-47. Alternatively, also sequences such as TERE (for example TEREL), KECE (for example KECEL or KECER), RERE (for example REREG), QERE (for example QEREG), KGRE (for example KGREG), KDRE (for example KDREV) are possible. Some other possible, but less preferred sequences include for example DECKL and NVCEL.
d) With both GLEW at positions 44-47 and KERE or KQRE at positions 43-46.
e) Often as KP or EP at positions 83-84 of naturally occurring $V_{HH}$ domains.
f) In particular, but not exclusively, in combination with GLEW at positions 44-47.
g) With the proviso that when positions 44-47 are GLEW, position 108 in (non-humanized) VHH sequences that also contain a W at 103.
h) The GLEW group also contains GLEW-like sequences at positions 44-47, such as for example GVEW, EPEW, GLER, DQEW, DLEW, GIEW, ELEW, GPEW, EWLP, GPER, GLER and ELEW.

TABLE A-4

Some preferred but non-limiting combinations of Hallmark Residues in naturally occurring Nanobodies.

| | 11 | 37 | 44 | 45 | 47 | 83 | 84 | 103 | 104 | 108 |
|---|---|---|---|---|---|---|---|---|---|---|
| DP-47 (human) | M | V | G | L | W | R | A | W | G | L |
| "KERE" group | L | F | E | R | L | K | P | W | G | Q |
| | L | F | E | R | F | E | P | W | G | Q |
| | L | F | E | R | F | K | P | W | G | Q |
| | L | Y | Q | R | L | K | P | W | G | Q |
| | L | F | L | R | V | K | P | Q | G | Q |
| | L | F | Q | R | L | K | P | W | G | Q |
| | L | F | E | R | F | K | P | W | G | Q |
| "GLEW" group | L | V | G | L | W | K | S | W | G | Q |
| | M | V | G | L | W | K | P | R | G | Q |

For humanization of these combinations, reference is made to the specification.

In the Nanobodies, each amino acid residue at any other position than the Hallmark Residues can be any amino acid residue that naturally occurs at the corresponding position (according to the Kabat numbering) of a naturally occurring $V_{HH}$ domain.

Such amino acid residues will be clear to the skilled person. Tables A-5-A-8 mention some non-limiting residues that can be present at each position (according to the Kabat numbering) of the FR1, FR2, FR3 and FR4 of naturally occurring $V_{HH}$ domains. For each position, the amino acid residue that most frequently occurs at each position of a naturally occurring $V_{HH}$ domain (and which is the most preferred amino acid residue for said position in a Nanobody) is indicated in bold; and other preferred amino acid residues for each position have been underlined (note: the number of amino acid residues that are found at positions 26-30 of naturally occurring $V_{HH}$ domains supports the hypothesis underlying the numbering by Chothia (supra) that the residues at these positions already form part of CDR1.)

In Tables A-5-A-8, some of the non-limiting residues that can be present at each position of a human $V_H3$ domain have also been mentioned. Again, for each position, the amino acid residue that most frequently occurs at each position of a naturally occurring human $V_H3$ domain is indicated in bold; and other preferred amino acid residues have been underlined.

For reference only, Tables A-5 to A-8 also contain data on the $V_{HH}$ entropy ("$V_{HH}$ Ent") and $V_{HH}$ variability ("$V_{HH}$ Var.") at each amino acid position for a representative sample of 1118 $V_{HH}$ sequences (data kindly provided by David Lutje Hulsing and Prof. Theo Verrips of Utrecht University). The values for the $V_{HH}$ entropy and the $V_{HH}$ variability provide a measure for the variability and degree of conservation of amino acid residues between the 1118 $V_{HH}$ sequences analyzed: low values (i.e. <1, such as <0.5) indicate that an amino acid residue is highly conserved between the $V_{HH}$ sequences (i.e. little variability). For example, the G at position 8 and the G at position 9 have values for the $V_{HH}$ entropy of 0.1 and 0 respectively, indicating that these residues are highly conserved and have little variability (and in case of position 9 is G in all 1118 sequences analysed), whereas for residues that form part of the CDR's generally values of 1.5 or more are found (data not shown). Note that (1) the amino acid residues listed in the second column of Tables A-5-A-8 are based on a bigger sample than the 1118 $V_{HH}$ sequences that were analysed for determining the $V_{HH}$ entropy and $V_{HH}$ variability referred to in the last two columns; and (2) the data represented below support the hypothesis that the amino acid residues at positions 27-30 and maybe even also at positions 93 and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE A-5

Non-limiting examples of amino acid residues in FR1 (for the footnotes, see the footnotes to Table A-3)

| | Amino acid residue(s): | | $V_{HH}$ | $V_{HH}$ |
|---|---|---|---|---|
| Position | Human $V_H3$ | Camelid $V_{HH}$'s | $V_{HH}$ Ent. | Var. |
| 1 | E, Q | Q, A, E | — | — |
| 2 | V | V | 0.2 | 1 |
| 3 | Q | Q, K | 0.3 | 2 |
| 4 | L | L | 0.1 | 1 |
| 5 | V, L | Q, E, L, V | 0.8 | 3 |
| 6 | E | E, D, Q, A | 0.8 | 4 |
| 7 | S, T | S, F | 0.3 | 2 |
| 8 | G, R | G | 0.1 | 1 |
| 9 | G | G | 0 | 1 |
| 10 | G, V | G, D, R | 0.3 | 2 |
| 11 | | Hallmark residue: L, M, S, V, W; preferably L | 0.8 | 2 |
| 12 | V, I | V, A | 0.2 | 2 |
| 13 | Q, K, R | Q, E, K, P, R | 0.4 | 4 |
| 14 | P | A, Q, A, G, P, S, T, V | 1 | 5 |
| 15 | G | G | 0 | 1 |
| 16 | G, R | G, A, E, D | 0.4 | 3 |
| 17 | S | S, F | 0.5 | 2 |
| 18 | L | L, V | 0.1 | 1 |
| 19 | R, K | R, K, L, N, S, T | 0.6 | 4 |
| 20 | L | L, F, I, V | 0.5 | 4 |
| 21 | S | S, A, F, T | 0.2 | 3 |
| 22 | C | C | 0 | 1 |
| 23 | A, T | A, D, E, P, S, T, V | 1.3 | 5 |
| 24 | A | A, I, L, S, T, V | 1 | 6 |

TABLE A-5-continued

Non-limiting examples of amino acid residues in FR1 (for the footnotes, see the footnotes to Table A-3)

| Position | Human V$_H$3 | Camelid V$_{HH}$'s | V$_{HH}$ Ent. | Var. |
|---|---|---|---|---|
| 25 | S | S, A, F, P, T | 0.5 | 5 |
| 26 | G | G, A, D, E, R, S, T, V | 0.7 | 7 |
| 27 | F | S, F, R, L, P, G, N, | 2.3 | 13 |
| 28 | T | N, T, E, D, S, I, R, A, G, R, F, Y | 1.7 | 11 |
| 29 | F, V | F, L, D, S, I, G, V, A | 1.9 | 11 |
| 30 | S, D, G | N, S, E, G, A, D, M, T | 1.8 | 11 |

TABLE A-6

Non-limiting examples of amino acid residues in FR2 (for the footnotes, see the footnotes to Table A-3)

| Position | Human V$_H$3 | Camelid V$_{HH}$'s | V$_{HH}$ Ent. | V$_{HH}$ Var. |
|---|---|---|---|---|
| 36 | W | W | 0.1 | 1 |
| 37 | | Hallmark residue: F$^{(1)}$, H, I, L, Y or V, preferably F$^{(1)}$ or Y | 1.1 | 6 |
| 38 | R | R | 0.2 | 1 |
| 39 | Q | Q, H, P, R | 0.3 | 2 |
| 40 | A | A, F, G, L, P, T, V | 0.9 | 7 |
| 41 | P, S, T | P, A, L, S | 0.4 | 3 |
| 42 | G | G, E | 0.2 | 2 |
| 43 | K | K, D, E, N, Q, R, T, V | 0.7 | 6 |
| 44 | | Hallmark residue: G$^{(2)}$, E$^{(3)}$, A, D, Q, R, S, L; preferably G$^{(2)}$, E$^{(3)}$ or Q; most preferably G$^{(2)}$ or E$^{(3)}$ | 1.3 | 5 |
| 45 | | Hallmark residue: L$^{(2)}$, R$^{(3)}$, C, I, L, P, Q, V; preferably L$^{(2)}$ or R$^{(3)}$ | 0.6 | 4 |
| 46 | E, V | E, D, K, Q, V | 0.4 | 2 |
| 47 | | Hallmark residue: W$^{(2)}$, L$^{(1)}$ or F$^{(1)}$, A, G, I, M, R, S, W or Y; preferably W$^{(2)}$, L$^{(1)}$, F$^{(1)}$ or R | 1.9 | 9 |
| 48 | V | V, I, L | 0.4 | 3 |
| 49 | S, A, G | A, S, G, T, V | 0.8 | 3 |

TABLE A-7

Non-limiting examples of amino acid residues in FR3 (for the footnotes, see the footnotes to Table A-3)

| Position | Human V$_H$3 | Camelid V$_{HH}$'s | V$_{HH}$ Ent. | Var. |
|---|---|---|---|---|
| 66 | R | R | 0.1 | 1 |
| 67 | F | F, L, V | 0.1 | 1 |
| 68 | T | T, A, N, S | 0.5 | 4 |
| 69 | I | I, L, M, V | 0.4 | 4 |
| 70 | S | S, A, F, T | 0.3 | 4 |
| 71 | R | R, G, H, I, L, K, Q, S, T, W | 1.2 | 8 |
| 72 | D, E | D, E, G, N, V | 0.5 | 4 |
| 73 | N, D, G | N, A, D, F, I, K, L, R, S, T, V, Y | 1.2 | 9 |
| 74 | A, S | A, D, G, N, P, S, T, V | 1 | 7 |
| 75 | K | K, A, E, K, L, N, Q, R | 0.9 | 6 |
| 76 | N, S | N, D, K, R, S, T, Y | 0.9 | 6 |
| 77 | S, T, I | T, A, E, I, M, P, S | 0.8 | 5 |
| 78 | L, A | V, L, A, F, G, I, M | 1.2 | 5 |
| 79 | Y, H | Y, A, D, F, H, N, S, T | 1 | 7 |
| 80 | L | L, F, V | 0.1 | 1 |
| 81 | Q | Q, E, I, L, R, T | 0.6 | 5 |
| 82 | M | M, I, L, V | 0.2 | 2 |
| 82a | N, G | N, D, G, H, S, T | 0.8 | 4 |

TABLE A-7-continued

Non-limiting examples of amino acid residues in FR3 (for the footnotes, see the footnotes to Table A-3)

| Position | Human V$_H$3 | Camelid V$_{HH}$'s | V$_{HH}$ Ent. | Var. |
|---|---|---|---|---|
| 82b | S | S, N, D, G, R, T | 1 | 6 |
| 82c | L | L, P, V | 0.1 | 2 |
| 83 | | Hallmark residue: R, K$^{(5)}$, N, E$^{(5)}$, G, I, M, Q or T; preferably K or R; most preferably K | 0.9 | 7 |
| 84 | | Hallmark residue: P$^{(5)}$, A, D, L, R, S, T, V; preferably P | 0.7 | 6 |
| 85 | E, G | E, D, G, Q | 0.5 | 3 |
| 86 | D | D | 0 | 1 |
| 87 | T, M | T, A, S | 0.2 | 3 |
| 88 | A | A, G, S | 0.3 | 2 |
| 89 | V, L | V, A, D, I, L, M, N, R, T | 1.4 | 6 |
| 90 | Y | Y, F | 0 | 1 |
| 91 | Y, H | Y, D, F, H, L, S, T, V | 0.6 | 4 |
| 92 | C | C | 0 | 1 |
| 93 | A, K, T | A, N, G, H, K, N, R, S, T, V, Y | 1.4 | 10 |
| 94 | K, R, T | A, V, C, F, G, I, K, L, R, S or T | 1.6 | 9 |

TABLE A-8

Non-limiting examples of amino acid residues in FR4 (for the footnotes, see the footnotes to Table A-3)

| Position | Human V$_H$3 | Camelid V$_{HH}$'s | V$_{HH}$ Ent. | Var. |
|---|---|---|---|---|
| 103 | | Hallmark residue: W$^{(4)}$, P$^{(6)}$, R$^{(6)}$, S; preferably W | 0.4 | 2 |
| 104 | | Hallmark residue: G or D; preferably G | 0.1 | 1 |
| 105 | Q, R | Q, E, K, P, R | 0.6 | 4 |
| 106 | G | G | 0.1 | 1 |
| 107 | T | T, A, I | 0.3 | 2 |
| 108 | | Hallmark residue: Q, L$^{(7)}$ or R; preferably Q or L$^{(7)}$ | 0.4 | 3 |
| 109 | V | V | 0.1 | 1 |
| 110 | T | T, I, A | 0.2 | 1 |
| 111 | V | V, A, I | 0.3 | 2 |
| 112 | S | S, F | 0.3 | 1 |
| 113 | S | S, A, L, P, T | 0.4 | 3 |

Thus, in another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a) the Hallmark residues are as defined herein;

and in which:

b) CDR1, CDR2 and CDR3 are as defined herein, and are preferably as defined according to one of the preferred embodiments herein, and are more preferably as defined according to one of the more preferred embodiments herein.

In another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

and in which
a) FR1 is chosen from the group consisting of the amino acid sequence:

[1] QVQLQESGGGXVQAGGSLRLSCAASG [26]  [SEQ ID NO: 1]

or from the group consisting of amino acid sequences that have at least 80%, preferably at least 90%, more preferably at least 95%, even more preferably at least 99% sequence identity (as defined herein) with the above amino acid sequence; in which
  i) any amino acid substitution at any position other than a Hallmark position is preferably either a conservative amino acid substitution (as defined herein) and/or an amino acid substitution as defined in Table A-5; and/or
  ii) said amino acid sequence preferably only contains amino acid substitutions, and no amino acid deletions or insertions, compared to the above amino acid sequence(s);
and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-5; and/or
  ii) said amino acid sequence preferably only contains amino acid substitutions, and no amino acid deletions or insertions, compared to the above amino acid sequence(s);
and in which:
b) FR2 is chosen from the group consisting of the amino acid sequence:

[36] WXRQAPGKXXEXVA [49]  [SEQ ID NO: 2]

or from the group consisting of amino acid sequences that have at least 80%, preferably at least 90%, more preferably at least 95%, even more preferably at least 99% sequence identity (as defined herein) with the above amino acid sequence; in which
  i) any amino acid substitution at any position other than a Hallmark position is preferably either a conservative amino acid substitution (as defined herein) and/or an amino acid substitution as defined in Table A-6; and/or
  ii) said amino acid sequence preferably only contains amino acid substitutions, and no amino acid deletions or insertions, compared to the above amino acid sequence(s);
and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-6; and/or
  ii) said amino acid sequence preferably only contains amino acid substitutions, and no amino acid deletions or insertions, compared to the above amino acid sequence(s);
and in which:
c) FR3 is chosen from the group consisting of the amino acid sequence:

[66] RFTISRDNAKNTVYLQMNSLXXEDTAVYYCAA [94]  [SEQ ID NO: 3]

or from the group consisting of amino acid sequences that have at least 80%, preferably at least 90%, more preferably at least 95%, even more preferably at least 99% sequence identity (as defined herein) with the above amino acid sequence; in which
  i) any amino acid substitution at any position other than a Hallmark position is preferably either a conservative amino acid substitution (as defined herein) and/or an amino acid substitution as defined in Table A-7; and/or
  ii) said amino acid sequence preferably only contains amino acid substitutions, and no amino acid deletions or insertions, compared to the above amino acid sequence(s);
and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-7; and/or
  ii) said amino acid sequence preferably only contains amino acid substitutions, and no amino acid deletions or insertions, compared to the above amino acid sequence(s);
and in which:
d) FR4 is chosen from the group consisting of the amino acid sequence:

[103] XXQGTXVTVSS [113]  [SEQ ID NO: 4]

or from the group consisting of amino acid sequences that have at least 80%, preferably at least 90%, more preferably at least 95%, even more preferably at least 99% sequence identity (as defined herein) with the above amino acid sequence; in which
  i) any amino acid substitution at any position other than a Hallmark position is preferably either a conservative amino acid substitution (as defined herein) and/or an amino acid substitution as defined in Table A-8; and/or
  ii) said amino acid sequence preferably only contains amino acid substitutions, and no amino acid deletions or insertions, compared to the above amino acid sequence(s);
and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-8; and/or
  ii) said amino acid sequence preferably only contains amino acid substitutions, and no amino acid deletions or insertions, compared to the above amino acid sequence(s);
and in which:
e) CDR1, CDR2 and CDR3 are as defined herein, and are preferably as defined according to one of the preferred embodiments herein, and are more preferably as defined according to one of the more preferred embodiments herein;
in which the Hallmark Residues are indicated by "X" and are as defined hereinabove and in which the numbers between brackets refer to the amino acid positions according to the Kabat numbering.

In another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a) FR1 is chosen from the group consisting of the amino acid sequence:

```
[1] QVQLQESGGGLVQAGGSLRLSCAASG [26]    [SEQ ID NO: 5]
``` or from the group consisting of amino acid sequences that have at least 80%, preferably at least 90%, more preferably at least 95%, even more preferably at least 99% sequence identity (as defined herein) with the above amino acid sequence; in which
i) any amino acid substitution at any position other than a Hallmark position is preferably either a conservative amino acid substitution (as defined herein) and/or an amino acid substitution as defined in Table A-5; and/or
ii) said amino acid sequence preferably only contains amino acid substitutions, and no amino acid deletions or insertions, compared to the above amino acid sequence(s); and
iii) the Hallmark residue at position is as indicated in the sequence above; and/or from the group consisting of amino acid sequences that have 3, 2 or only 1 "amino acid difference(s)" (as defined herein) with one of the above amino acid sequences, in which:
i) any amino acid substitution at any position other than a Hallmark position is preferably either a conservative amino acid substitution (as defined herein) and/or an amino acid substitution as defined in Table A-5; and/or
ii) said amino acid sequence preferably only contains amino acid substitutions, and no amino acid deletions or insertions, compared to the above amino acid sequence(s); and
iii) the Hallmark residue at position is as indicated in the sequence above;

and in which:
b) FR2 is chosen from the group consisting of the amino acid sequences:

```
[36] WFRQAPGKERELVA [49]    [SEQ ID NO: 6]

[36] WFRQAPGKEREFVA [49]    [SEQ ID NO: 7]

[36] WFRQAPGKEREGA [49]     [SEQ ID NO: 8]

[36] WFRQAPGKQRELVA [49]    [SEQ ID NO: 9]

[36] WFRQAPGKQREFVA [49]    [SEQ ID NO: 10]

[36] WYRQAPGKGLEWA [49]     [SEQ ID NO: 11]
``` or from the group consisting of amino acid sequences that have at least 80%, preferably at least 90%, more preferably at least 95%, even more preferably at least 99% sequence identity (as defined herein) with one of the above amino acid sequences; in which
i) any amino acid substitution at any position other than a Hallmark position is preferably either a conservative amino acid substitution (as defined herein) and/or an amino acid substitution as defined in Table A-6; and/or
ii) said amino acid sequence preferably only contains amino acid substitutions, and no amino acid deletions or insertions, compared to the above amino acid sequence(s); and
iii) the Hallmark residues at positions 37, 44, 45 and 47 are as indicated in each of the sequences above;
and/or from the group consisting of amino acid sequences that have 3, 2 or only 1 "amino acid difference(s)" (as defined herein) with one of the above amino acid sequences, in which:
i) any amino acid substitution at any position other than a Hallmark position is preferably either a conservative amino acid substitution (as defined herein) and/or an amino acid substitution as defined in Table A-6; and/or
ii) said amino acid sequence preferably only contains amino acid substitutions, and no amino acid deletions or insertions, compared to the above amino acid sequence(s); and
iii) the Hallmark residues at positions 37, 44, 45 and 47 are as indicated in each of the sequences above;

and in which:
c) FR3 is chosen from the group consisting of the amino acid sequence:

```
                                        [SEQ ID NO: 12]
[66] RFTISRDNAKNTVYLQMNSLKPEDTAVYYCAA [94]
``` or from the group consisting of amino acid sequences that have at least 80%, preferably at least 90%, more preferably at least 95%, even more preferably at least 99% sequence identity (as defined herein) with the above amino acid sequence; in which
i) any amino acid substitution at any position other than a Hallmark position is preferably either a conservative amino acid substitution (as defined herein) and/or an amino acid substitution as defined in Table A-7; and/or
ii) said amino acid sequence preferably only contains amino acid substitutions, and no amino acid deletions or insertions, compared to the above amino acid sequence(s); and
iii) the Hallmark residues at positions 83 and 84 are as indicated in each of the sequences above;
and/or from the group consisting of amino acid sequences that have 3, 2 or only 1 "amino acid difference(s)" (as defined herein) with one of the above amino acid sequences, in which:
i) any amino acid substitution at any position other than a Hallmark position is preferably either a conservative amino acid substitution (as defined herein) and/or an amino acid substitution as defined in Table A-7; and/or
ii) said amino acid sequence preferably only contains amino acid substitutions, and no amino acid deletions or insertions, compared to the above amino acid sequence(s); and
iii) the Hallmark residues at positions 83 and 84 are as indicated in each of the sequences above;

and in which:
d) FR4 is chosen from the group consisting of the amino acid sequences:

```
[103] WGQGTQVTVSS [113]    [SEQ ID NO: 13]

[103] WGQGTLVTVSS [113]    [SEQ ID NO: 14]
``` or from the group consisting of amino acid sequences that have at least 80%, preferably at least 90%, more preferably at least 95%, even more preferably at least 99% sequence identity (as defined herein) with one of the above amino acid sequence; in which
i) any amino acid substitution at any position other than a Hallmark position is preferably either a conservative amino acid substitution (as defined herein) and/or an amino acid substitution as defined in Table A-8; and/or ii) said amino acid sequence preferably only contains amino acid substitutions, and no amino acid deletions or insertions, compared to the above amino acid sequence(s); and iii) the Hallmark residues at positions 103, 104 and 108 are as indicated in each of the sequences above;

and/or from the group consisting of amino acid sequences that have 3, 2 or only 1 "amino acid difference(s)" (as defined herein) with one of the above amino acid sequences, in which:

i) any amino acid substitution at any position other than a Hallmark position is preferably either a conservative amino acid substitution (as defined herein) and/or an amino acid substitution as defined in Table A-8; and/or ii) said amino acid sequence preferably only contains amino acid substitutions, and no amino acid deletions or insertions, compared to the above amino acid sequence(s); and iii) the Hallmark residues at positions 103, 104 and 108 are as indicated in each of the sequences above;

and in which:

e) CDR1, CDR2 and CDR3 are as defined herein, and are preferably as defined according to one of the preferred embodiments herein, and are more preferably as defined according to one of the more preferred embodiments herein.

In another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

and in which a) FR1 is chosen from the group consisting of the amino acid sequence:

[1] QVQLQESGGGLVQAGGSLRLSCAASG [26]   [SEQ ID NO: 5]

and/or from the group consisting of amino acid sequences that have 3, 2 or only 1 "amino acid difference(s)" (as defined herein) with one of the above amino acid sequences, in which:

i) any amino acid substitution at any position other than a Hallmark position is preferably either a conservative amino acid substitution (as defined herein) and/or an amino acid substitution as defined in Table A-5; and/or ii) said amino acid sequence preferably only contains amino acid substitutions, and no amino acid deletions or insertions, compared to the above amino acid sequence(s); and iii) the Hallmark residue at position is as indicated in the sequence above;

and in which:

b) FR2 is chosen from the group consisting of the amino acid sequences:

[36] WFRQAPGKERELVA [49]   [SEQ ID NO: 6]

[36] WFRQAPGKEREFVA [49]   [SEQ ID NO: 7]

[36] WFRQAPGKEREGA [49]   [SEQ ID NO: 8]

-continued

[36] WFRQAPGKQRELVA [49]   [SEQ ID NO: 9]

[36] WFRQAPGKQREFVA [49]   [SEQ ID NO: 10]

and/or from the group consisting of amino acid sequences that have 2 or only 1 "amino acid difference(s)" (as defined herein) with one of the above amino acid sequences, in which:

i) any amino acid substitution at any position other than a Hallmark position is preferably either a conservative amino acid substitution (as defined herein) and/or an amino acid substitution as defined in Table A-6; and/or ii) said amino acid sequence preferably only contains amino acid substitutions, and no amino acid deletions or insertions, compared to the above amino acid sequence(s); and iii) the Hallmark residues at positions 37, 44, 45 and 47 are as indicated in each of the sequences above;

and in which:

c) FR3 is chosen from the group consisting of the amino acid sequence:

[SEQ ID NO: 12]
[66] RFTISRDNAKNTVYLQMNSLKPEDTAVYYCAA [94]

and/or from the group consisting of amino acid sequences that have 3, 2 or only 1 "amino acid difference(s)" (as defined herein) with one of the above amino acid sequences, in which:

i) any amino acid substitution at any position other than a Hallmark position is preferably either a conservative amino acid substitution (as defined herein) and/or an amino acid substitution as defined in Table A-7; and/or ii) said amino acid sequence preferably only contains amino acid substitutions, and no amino acid deletions or insertions, compared to the above amino acid sequence(s); and iii) the Hallmark residues at positions 83 and 84 are as indicated in each of the sequences above;

and in which:

d) FR4 is chosen from the group consisting of the ammo acid sequences:

[103] WGQGTQVTVSS [113]   [SEQ ID NO: 13]

[103] WGQGTLVTVSS [113]   [SEQ ID NO: 14]

and/or from the group consisting of amino acid sequences that have 3, 2 or only 1 "amino acid difference(s)" (as defined herein) with one of the above amino acid sequences, in which:

i) any amino acid substitution at any position other than a Hallmark position is preferably either a conservative amino acid substitution (as defined herein) and/or an amino acid substitution as defined in Table A-8; and/or ii) said amino acid sequence preferably only contains amino acid substitutions, and no amino acid deletions or insertions, compared to the above amino acid sequence(s); and iii) the Hallmark residues at positions 103, 104 and 108 are as indicated in each of the sequences above;

and in which:

e) CDR1, CDR2 and CDR3 are as defined herein, and are preferably as defined according to one of the preferred embodiments herein, and are more preferably as defined according to one of the more preferred embodiments herein.

In another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a) FR1 is chosen from the group consisting of the amino acid sequence:

[1] QVQLQESGGGLVQAGGSLRLSCAASG [26]        [SEQ ID NO: 5]

and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-5; and/or
  ii) said amino acid sequence preferably only contains amino acid substitutions, and no amino acid deletions or insertions, compared to the above amino acid sequence(s); and
  iii) the Hallmark residue at position is as indicated in the sequence above;

and in which:

b) FR2 is chosen from the group consisting of the amino acid sequence:

[36] WYRQAPGKGLEWA [49]        [SEQ ID NO: 11]

and/or from the group consisting of amino acid sequences that have 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-6; and/or
  ii) said amino acid sequence preferably only contains amino acid substitutions, and no amino acid deletions or insertions, compared to the above amino acid sequence(s); and
  iii) the Hallmark residues at positions 37, 44, 45 and 47 are as indicated in each of the sequences above;

and in which:

c) FR3 is chosen from the group consisting of the amino acid sequence:

[SEQ ID NO: 12]
[66] RFTISRDNAKNTVYLQMNSLKPEDTAVYYCAA [94]

and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-7; and/or
  ii) said amino acid sequence preferably only contains amino acid substitutions, and no amino acid deletions or insertions, compared to the above amino acid sequence(s); and
  iii) the Hallmark residues at positions 83 and 84 are as indicated in each of the sequences above;

and in which:

d) FR4 is chosen from the group consisting of the amino acid sequence:

[103] WGQGTQVTVSS [113]        [SEQ ID NO: 13]

and/or from the group consisting of amino acid sequences that have 3, 2 or only 1 "amino acid difference(s)" (as defined herein) with one of the above amino acid sequences, in which:
  i) any amino acid substitution at any position other than a Hallmark position is preferably either a conservative amino acid substitution (as defined herein) and/or an amino acid substitution as defined in Table A-8; and/or
  ii) said amino acid sequence preferably only contains amino acid substitutions, and no amino acid deletions or insertions, compared to the above amino acid sequence(s); and
  iii) the Hallmark residues at positions 103, 104 and 108 are as indicated in each of the sequences above;

and in which:

e) CDR1, CDR2 and CDR3 are as defined herein, and are preferably as defined according to one of the preferred embodiments herein, and are more preferably as defined according to one of the more preferred embodiments herein.

Some other framework sequences that can be present in the Nanobodies of the invention can be found in the European patent EP 656 946 mentioned above (see for example also the granted U.S. Pat. No. 5,759,808), In another preferred, but not limiting aspect, a Nanobody of the invention can have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

and in which a) FR1 is chosen from the group consisting of the amino acid sequences of SEQ ID NO's: 42-92, or from the group consisting of amino acid sequences that have at least 80%, preferably at least 90%, more preferably at least 95%, even more preferably at least 99% sequence identity (as defined herein) with at least one of said FR1 sequences; in which
  i) any amino acid substitution at any position other than a Hallmark position is preferably either a conservative amino acid substitution (as defined herein) and/or an amino acid substitution as defined in Table A-5; and/or
  ii) said amino acid sequence preferably only contains amino acid substitutions, and no amino acid deletions or insertions, compared to said FR1 sequence; and
  iii) the Hallmark residue at position is as indicated in said FR1 sequence;

and/or from the group consisting of amino acid sequences that have 3, 2 or only 1 "amino acid difference(s)" (as defined herein) with at least one of said FR1 sequences, in which:
  i) any amino acid substitution at any position other than a Hallmark position is preferably either a conservative amino acid substitution (as defined herein) and/or an amino acid substitution as defined in Table A-5; and/or
  ii) said amino acid sequence preferably only contains amino acid substitutions, and no amino acid deletions or insertions, compared to said FR1 sequence; and iii) the Hallmark residue at position is as indicated in said FR1 sequence;
and in which:
b) FR2 is chosen from the group consisting of the amino acid sequences of SEQ ID NO's: 144-194,
or from the group consisting of amino acid sequences that have at least 80%, preferably at least 90%, more preferably at least 95%, even more preferably at least 99% sequence identity (as defined herein) with at least one of said FR2 sequences; in which
  i) any amino acid substitution at any position other than a Hallmark position is preferably either a conservative amino acid substitution (as defined herein) and/or an amino acid substitution as defined in Table A-6; and/or
  ii) said amino acid sequence preferably only contains amino acid substitutions, and no amino acid deletions or insertions, compared to said FR2 sequence; and
  iii) the Hallmark residues at positions 37, 44, 45 and 47 are as indicated in said FR2 sequence;
  and/or from the group consisting of amino acid sequences that have 3, 2 or only 1 "amino acid difference(s)" (as defined herein) with at least one of said FR2 sequences, in which:
  i) any amino acid substitution at any position other than a Hallmark position is preferably either a conservative amino acid substitution (as defined herein) and/or an amino acid substitution as defined in Table A-6; and/or
  ii) said amino acid sequence preferably only contains amino acid substitutions, and no amino acid deletions or insertions, compared to said FR2 sequence; and
  iii) the Hallmark residues at positions 37, 44, 45 and 47 are as indicated in said FR2 sequence;
and in which:
c) FR3 is chosen from the group consisting of the amino acid sequences of SEQ ID NO's: 246-296, or from the group consisting of amino acid sequences that have at least 80%, preferably at least 90%, more preferably at least 95%, even more preferably at least 99% sequence identity (as defined herein) with at least one of said FR3 sequences; in which
  i) any amino acid substitution at any position other than a Hallmark position is preferably either a conservative amino acid substitution (as defined herein) and/or an amino acid substitution as defined in Table A-7; and/or
  ii) said amino acid sequence preferably only contains amino acid substitutions, and no amino acid deletions or insertions, compared to said FR3 sequence; and
  iii) the Hallmark residues at positions 83 and 84 are as indicated in said FR3 sequence;
  and/or from the group consisting of amino acid sequences that have 3, 2 or only 1 "amino acid difference(s)" (as defined herein) with at least one of said FR3 sequences, in which:
  i) any amino acid substitution at any position other than a Hallmark position is preferably either a conservative amino acid substitution (as defined herein) and/or an amino acid substitution as defined in Table A-7; and/or
  ii) said amino acid sequence preferably only contains amino acid substitutions, and no amino acid deletions or insertions, compared to said FR3 sequence; and
  iii) the Hallmark residues at positions 83 and 84 are as indicated in said FR3 sequence;
and in which:
d) FR4 is chosen from the group consisting of the amino acid sequences of SEQ ID NO's: 348-398,
or from the group consisting of amino acid sequences that have at least 80%, preferably at least 90%, more preferably at least 95%, even more preferably at least 99% sequence identity (as defined herein) with at least one of said FR4 sequences; in which
  i) any amino acid substitution at any position other than a Hallmark position is preferably either a conservative amino acid substitution (as defined herein) and/or an amino acid substitution as defined in Table A-8; and/or
  ii) said amino acid sequence preferably only contains amino acid substitutions, and no amino acid deletions or insertions, compared to said FR4 sequence; and
  iii) the Hallmark residues at positions 103, 104 and 108 are as indicated in said FR3 sequence;
  and/or from the group consisting of amino acid sequences that have 3, 2 or only 1 "amino acid difference(s)" (as defined herein) with at least one of said FR4 sequences, in which:
  i) any amino acid substitution at any position other than a Hallmark position is preferably either a conservative amino acid substitution (as defined herein) and/or an amino acid substitution as defined in Table A-8; and/or
  ii) said amino acid sequence preferably only contains amino acid substitutions, and no amino acid deletions or insertions, compared to said FR4 sequence; and
  iii) the Hallmark residues at positions 103, 104 and 108 are as indicated in said FR4 sequence;
and in which:
e) CDR1, CDR2 and CDR3 are as defined herein, and are preferably as defined according to one of the preferred embodiments herein, and are more preferably as defined according to one of the more preferred embodiments herein.

Some particularly preferred Nanobodies of the invention can be chosen from the group consisting of the amino acid sequences of SEQ ID NO's: 399-449, or from the group consisting of amino acid sequences that have at least 80%, preferably at least 90%, more preferably at least 95%, even more preferably at least 99% sequence identity (as defined herein) with at least one of said amino acid sequences; in which
a) the Hallmark residues can be as indicated in Table A-3 above;
b) any amino acid substitution at any position other than a Hallmark position is preferably either a conservative amino acid substitution (as defined herein) and/or an amino acid substitution as defined in Tables A-5-A-8; and/or
c) said amino acid sequence preferably only contains amino acid substitutions, and no amino acid deletions or insertions, compared to the above amino acid sequence(s).

Some even more particularly preferred Nanobodies of the invention can be chosen from the group consisting of the amino acid sequences of SEQ ID NO's: 399-449, or from the group consisting of amino acid sequences that have at least 80%, preferably at least 90%, more preferably at least 95%, even more preferably at least 99% sequence identity (as defined herein) with at least one of said amino acid sequences; in which
a) the Hallmark residues are as indicated in the pertinent sequence from SEQ ID NO's: 399-449;
b) any amino acid substitution at any position other than a Hallmark position is preferably either a conservative amino acid substitution (as defined herein) and/or an amino acid substitution as defined in Tables A-5-A-8; and/or
c) said amino acid sequence preferably only contains amino acid substitutions, and no amino acid deletions or insertions, compared to the pertinent sequence chosen from SEQ ID NO's: 399-449.

Some of the most preferred Nanobodies of the invention against the IL-6 receptor can be chosen from the group consisting of the amino acid sequences of SEQ ID NO's: 399-449.

Preferably, the CDR sequences and FR sequences in the Nanobodies of the invention are such that the Nanobody of the invention binds to the IL-6 receptor, with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:
bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to IL-6R with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;
and/or such that they:
bind to IL-6R with a $k_{off}$-rate between 1 $s^{-1}$ ($t_{1/2}$=0.69 s) and $10^6$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 pM.

Some preferred $IC_{50}$ values for binding of the amino acid sequences or polypeptides of the invention to IL-6R will become clear from the further description and examples herein.

According to one non-limiting aspect of the invention, a Nanobody may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a Nanobody may be as defined herein, but with the proviso that it has at least "one amino acid difference" (as defined herein) at least one of the Hallmark residues (including those at positions 108, 103 and/or 45) compared to the corresponding framework region of a naturally occurring human $V_H$ domain, and in particular compared to the corresponding framework region of DP-47. Usually, a Nanobody will have at least one such amino acid difference with a naturally occurring $V_H$ domain in at least one of FR2 and/or FR4, and in particular at least one of the Hallmark residues in FR2 and/or FR4 (again, including those at positions 108, 103 and/or 45).

Also, a humanized Nanobody of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized Nanobody may be as defined herein, but with the proviso that it has at least "one amino acid difference" (as defined herein) at least one of the Hallmark residues (including those at positions 108, 103 and/or 45) compared to the corresponding framework region of a naturally occurring $V_{HH}$ domain. Usually, a humanized Nanobody will have at least one such amino acid difference with a naturally occurring $V_{HH}$ domain in at least one of FR2 and/or FR4, and in particular at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the Nanobodies of the invention as defined herein, and in particular analogs of the Nanobodies of SEQ ID NO's: 399-449. Thus, according to one embodiment of the invention, the term "Nanobody of the invention" in its broadest sense also covers such analogs.

Generally, in such analogs, one or more amino acid residues may have been replaced, deleted and/or added, compared to the Nanobodies of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables A-5-A-8 for some non-limiting examples of such substitutions), although the invention is generally not limited thereto. Thus, any one or more substitutions, deletions or insertions, or any combination thereof, that either improve the properties of the Nanobody of the invention or that at least do not detract too much from the desired properties or from the balance or combination of desired properties of the Nanobody of the invention (i.e. to the extent that the Nanobody is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the Nanobodies thus obtained.

For example, and depending on the host organism used to express the Nanobody or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables A-5-A-8 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to the IL-6 receptor, with affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:

bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to IL-6R with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to IL-6R with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 pM.

Some preferred IC50 values for binding of the amino acid sequences or polypeptides of the invention to IL-6R will become clear from the further description and examples herein.

The analogs are preferably also such that they retain the favourable properties the Nanobodies, as described herein.

Also, according to one preferred embodiment, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the Nanobodies of SEQ ID NOs 399-449.

Also, the framework sequences and CDR's of the analogs are preferably such that they are in accordance with the preferred embodiments defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the Nanobodies of the invention comprise Nanobodies that have been humanized (i.e. compared to the sequence of a naturally occurring Nanobody of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a Nanobody and the sequence of a naturally occurring human $V_H$ domain.

The humanizing substitutions should be chosen such that the resulting humanized Nanobodies still retain the favourable properties of Nanobodies as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the Nanobodies thus obtained.

Generally, as a result of humanization, the Nanobodies of the invention may become more "human-like", while still retaining the favorable properties of the Nanobodies of the invention as described herein. As a result, such humanized Nanobodies may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The Nanobodies of the invention may be suitably humanized at any framework residue(s), such as at one or more Hallmark residues (as defined herein) or at one or more other framework residues (i.e. non-Hallmark residues) or any suitable combination thereof. One preferred humanizing substitution for Nanobodies of the "P, R, S-103 group" or the "KERE group" is Q108 into L108. Nanobodies of the "GLEW class" may also be humanized by a Q108 into L108 substitution, provided at least one of the other Hallmark residues contains a camelid (camelizing) substitution (as defined herein). For example, as mentioned above, one particularly preferred class of humanized Nanobodies has GLEW or a GLEW-like sequence at positions 44-47; P, R or S (and in particular R) at position 103, and an L at position 108.

The humanized and other analogs, and nucleic acid sequences encoding the same, can be provided in any manner known per se. For example, the analogs can be obtained by providing a nucleic acid that encodes a naturally occurring $V_{HH}$ domain, changing the codons for the one or more amino acid residues that are to be substituted into the codons for the corresponding desired amino acid residues (e.g. by site-directed mutagenesis or by PCR using suitable mismatch primers), expressing the nucleic acid/nucleotide sequence thus obtained in a suitable host or expression system; and optionally isolating and/or purifying the analog thus obtained to provide said analog in essentially isolated form (e.g. as further described herein). This can generally be performed using methods and techniques known per se, which will be clear to the skilled person, for example from the handbooks and references cited herein, the background art cited herein and/or from the further description herein. Alternatively, a nucleic acid encoding the desired analog can be synthesized in a manner known per se (for example using an automated apparatus for synthesizing nucleic acid sequences with a predefined amino acid sequence) and can then be expressed as described herein. Yet another technique may involve combining one or more naturally occurring and/or synthetic nucleic acid sequences each encoding a part of the desired analog, and then expressing the combined nucleic acid sequence as described herein. Also, the analogs can be provided using chemical synthesis of the pertinent amino acid sequence using techniques for peptide synthesis known per se, such as those mentioned herein.

In this respect, it will be also be clear to the skilled person that the Nanobodies of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a Nanobody of the invention and/or so as to confer the favourable properties of a Nanobody to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables A-5-A-8. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of Nanobodies are obtained or improved (i.e. compared to the original $V_H$ domain).

Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a Nanobody of the invention and/or in an analog thereof (as defined herein), such as in a humanized analog and/or preferably in an analog that is as defined in the preceding paragraphs.

As will also be clear from the disclosure herein, it is also within the scope of the invention to use parts or fragments, or combinations of two or more parts or fragments, of the Nanobodies of the invention as defined herein, and in particular parts or fragments of the Nanobodies of SEQ ID NO's 399-449. Thus, according to one embodiment of the invention, the term "Nanobody of the invention" in its broadest sense also covers such parts or fragments.

Generally, such parts or fragments of the Nanobodies of the invention (including analogs thereof) have amino acid sequences in which, compared to the amino acid sequence of the corresponding full length Nanobody of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to the IL-6 receptor, with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:
bind to IL-6R with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:
bind to IL-6R with a $k_{on}$-rate of between $10^2$ M$^{-1}$s$^{-1}$ to about $10^7$M$^{-1}$s$^{-1}$, preferably between $10^3$ M$^1$s$^{-1}$ and $10^7$ M$^{-1}$s$^{-1}$, more preferably between $10^4$ M$^{-1}$s$^{-1}$ and $10^7$ M$^{-1}$s$^{-1}$, such as between $10^5$ M$^1$s$^{-1}$ and $10^7$ M$^{-1}$s$^{-1}$;

and/or such that they:
bind to IL-6R with a $k_{off}$ rate between 1 s$^{-1}$ ($t_{1/2}$=0.69 s) and $10^{-6}$ s$^{-1}$ (providing a near irreversible complex with a $t_{1/2}$ of multiple days), preferably between $10^{-2}$ s$^{-1}$ and $10^{-6}$ s$^{-1}$, more preferably between $10^{-3}$ s$^{-1}$ and $10^{-4}$ s$^{-1}$, such as between $10^4$ s−1 and $10^{-6}$ s$^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 pM.

Some preferred IC50 values for binding of the amino acid sequences or polypeptides of the invention to IL-6R will become clear from the further description and examples herein.

The affinity of the analog against the IL-6 receptor, can be determined in a manner known per se, for example using the assay described herein.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length Nanobody of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting embodiment, such a part or fragment comprises at least CDR3, such as FR3, CDR3 and FR4 of the corresponding full length Nanobody of the invention, i.e. as for example described in the International application WO 03/050531 (Lasters et al.).

As already mentioned above, it is also possible to combine two or more of such parts or fragments (i.e. from the same or different Nanobodies of the invention), i.e. to provide an analog (as defined herein) and/or to provide further parts or fragments (as defined herein) of a Nanobody of the invention. It is for example also possible to combine one or more parts or fragments of a Nanobody of the invention with one or more parts or fragments of a human $V_H$ domain.

According to one preferred embodiment, the parts or fragments have a degree of sequence identity of at least 50%, preferably at least 60%, more preferably at least 70%, even more preferably at least 80%, such as at least 90%, 95% or 99% or more with one of the Nanobodies of SEQ ID NOs: 399-449.

The parts and fragments, and nucleic acid sequences encoding the same, can be provided and optionally combined in any manner known per se. For example, such parts or fragments can be obtained by inserting a stop codon in a nucleic acid that encodes a full-sized Nanobody of the invention, and then expressing the nucleic acid thus obtained in a manner known per se (e.g. as described herein). Alternatively, nucleic acids encoding such parts or fragments can be obtained by suitably restricting a nucleic acid that encodes a full-sized Nanobody of the invention or by synthesizing such a nucleic acid in a manner known per se. Parts or fragments may also be provided using techniques for peptide synthesis known per se.

The invention in its broadest sense also comprises derivatives of the Nanobodies of the invention. Such derivatives can generally be obtained by modification, and in particular by chemical and/or biological (e.g. enzymatical) modification, of the Nanobodies of the invention and/or of one or more of the amino acid residues that form the Nanobodies of the invention.

Examples of such modifications, as well as examples of amino acid residues within the Nanobody sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the Nanobody of the invention, and in particular of one or more functional groups, residues or moieties that confer one or more desired properties or functionalities to the Nanobody of the invention. Example of such functional groups will be clear to the skilled person.

For example, such modification may comprise the introduction (e.g. by covalent binding or in any other suitable manner) of one or more functional groups that that increase the half-life, the solubility and/or the absorption of the Nanobody of the invention, that reduce the immunogenicity and/or the toxicity of the Nanobody of the invention, that eliminate or attenuate any undesirable side effects of the Nanobody of the invention, and/or that confer other advantageous properties to and/or reduce the undesired properties of the Nanobodies and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a Nanobody of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a Nanobody of the invention, a Nanobody of the invention may be modified so as to suitably introduce one or more cysteine residues for attachment of PEG, or an amino acid sequence comprising one or more cysteine residues for attachment of PEG may be fused to the N- and/or C-terminus of a Nanobody of the invention, all using techniques of protein engineering known per se to the skilled person.

Preferably, for the Nanobodies and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the Nanobody or polypeptide of the invention.

Yet another modification may comprise the introduction of one or more detectable labels or other signal-generating groups or moieties, depending on the intended use of the labelled Nanobody. Suitable labels and techniques for attaching, using and detecting them will be clear to the skilled person, and for example include, but are not limited to, fluorescent labels (such as fluorescein, isothiocyanate, rhodamine, phycoerythrin, phycocyanin, allophycocyanin, o-phthaldehyde, and fluorescamine and fluorescent metals such as $^{152}$Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes (such as $^{3}$H, $^{125}$I, $^{32}$P, $^{35}$S, $^{14}$C, $^{51}$Cr, $^{36}$Cl, $^{57}$Co, $^{58}$Co, $^{59}$Fe, and $^{75}$Se), metals, metals chelates or metallic cations (for example metallic cations such as $^{99m}$Tc, $^{123}$I, $^{111}$In, $^{131}$I, $^{97}$Ru, $^{67}$Cu, $^{67}$Ga, and $^{68}$Ga or other metals or metallic cations that are particularly suited for use in in vivo, in vitro or in situ diagnosis and imaging, such as ($^{157}$Gd, $^{55}$Mn, $^{162}$Dy, $^{52}$Cr, and $^{56}$Fe), as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, β-galactosidase, ribonuclease, urease, catalase, glucose-VI-phosphate dehydrogenase, glucoamylase and acetylcholine esterase). Other suitable labels will be clear to the skilled person, and for example include moieties that can be detected using NMR or ESR spectroscopy.

Such labelled Nanobodies and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the Nanobody of the invention to another protein, polypeptide or chemical compound that is bound to the other half of the binding pair, i.e. through formation of the binding pair. For example, a Nanobody of the invention may be conjugated to biotin, and linked to another protein, polypeptide, compound or carrier conjugated to avidin or streptavidin. For example, such a conjugated Nanobody may be used as a reporter, for example in a diagnostic system where a detectable signal-producing agent is conjugated to avidin or streptavidin. Such binding pairs may for example also be used to bind the Nanobody of the invention to a carrier, including carriers suitable for pharmaceutical purposes. One non-limiting example are the liposomal formulations described by Cao and Suresh, Journal of Drug Targeting, 8, 4, 257 (2000). Such binding pairs may also be used to link a therapeutically active agent to the Nanobody of the invention.

For some applications, in particular for those applications in which it is intended to kill a cell that expresses the target against which the Nanobodies of the invention are directed (e.g. in the treatment of cancer), or to reduce or slow the growth and/or proliferation such a cell, the Nanobodies of the invention may also be linked to a toxin or to a toxic residue or moiety. Examples of toxic moieties, compounds or residues which can be linked to a Nanobody of the invention to provide—for example—a cytotoxic compound will be clear to the skilled person and can for example be found in the prior art cited above and/or in the further description herein. One example is the so-called ADEPT™ technology WO 03/055527.

Other potential chemical and enzymatic modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to the IL-6 receptor, with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:
bind to IL-6R with a dissociation constant ($K_D$) of $10^{-5}$ to $10^{-12}$ moles/liter or less, and preferably $10^{-7}$ to $10^{-12}$ moles/liter or less and more preferably $10^4$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:
bind to IL-6R with a $k_{on}$-rate of between $10^2$ M$^{-1}$s$^{-1}$ to about $10^7$ M$^{-1}$s$^{-1}$, preferably between $10^3$ M$^{-1}$s$^{-1}$ and $10^7$ M$^{-1}$s$^{-1}$, more preferably between $10^4$ M$^{-1}$s$^{-1}$ and $10^7$ M$^{-1}$s$^{-1}$, such as between $10^5$ M$^{-1}$s$^{-1}$ and $10^7$ M$^{-1}$s$^{-1}$;

and/or such that they:
bind to IL-6R with a $k_{off}$-rate between $1$ s$^{-1}$ ($t_{1/2}$=0.69 s) and $10^{-6}$ s$^{-1}$ (providing a near irreversible complex with a $t_{1/2}$ of multiple days), preferably between $10^{-2}$ s$^{-1}$ and $10^{-6}$ s$^{-1}$, more preferably between $10^{-3}$ s$^{-1}$ and $10^{-6}$ s$^{-1}$, such as between $10^{-4}$ s$^{-1}$ and $10^{-6}$ s$^{-1}$.

Preferably, a monovalent amino acid sequence of the invention (or a polypeptide that contains only one amino acid sequence of the invention) is preferably such that it will bind to IL-6R with an affinity less than 500 nM, preferably less than 200 nM, more preferably less than 10 nM, such as less than 500 pM.

Some preferred IC50 values for binding of the amino acid sequences or polypeptides of the invention to IL-6R will become clear from the further description and examples herein.

The affinity of a derivative of a Nanobody of the invention against the IL-6 receptor, can be determined in a manner known per se, for example using the assay described herein.

As mentioned above, the invention also relates to proteins or polypeptides that essentially consist of or comprise at least one Nanobody of the invention. By "essentially consist of" is meant that the amino acid sequence of the polypeptide of the invention either is exactly the same as the amino acid sequence of a Nanobody of the invention or corresponds to the amino acid sequence of a Nanobody of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the Nanobody.

Said amino acid residues may or may not change, alter or otherwise influence the (biological) properties of the Nanobody and may or may not add further functionality to the Nanobody. For example, such amino acid residues:

a) can comprise an N-terminal Met residue, for example as result of expression in a heterologous host cell or host organism.

b) may form a signal sequence or leader sequence that directs secretion of the Nanobody from a host cell upon synthesis. Suitable secretory leader peptides will be clear to the skilled person, and may be as further described herein. Usually, such a leader sequence will be linked to the N-terminus of the Nanobody, although the invention in its broadest sense is not limited thereto;

c) may form a sequence or signal that allows the Nanobody to be directed towards and/or to penetrate or enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such amino acid sequences will be clear to the skilled person. Some non-limiting examples are the small peptide vectors ("Pep-trans vectors") described in WO 03/026700 and in Temsamani et al., Expert Opin. Biol. Ther., 1, 773 (2001); Temsamani and Vidal, Drug Discov. Today, 9, 1012 (004) and Rousselle, J. Pharmacol. Exp. Ther., 296, 124-131 (2001), and the membrane translocator sequence described by Zhao et al., Apoptosis, 8, 631-637 (2003). C-terminal and N-terminal amino acid sequences for intracellular targeting of antibody fragments are for example described by Cardinale et al., Methods, 34, 171 (2004). Other suitable techniques for intracellular targeting involve the expression and/or use of so-called "intrabodies" comprising a Nanobody of the invention, as mentioned below;

d) may form a "tag", for example an amino acid sequence or residue that allows or facilitates the purification of the Nanobody, for example using affinity techniques directed against said sequence or residue. Thereafter, said sequence or residue may be removed (e.g. by chemical or enzymatical cleavage) to provide the Nanobody sequence (for this purpose, the tag may optionally be linked to the Nanobody sequence via a cleavable linker sequence or contain a cleavable motif). Some preferred, but non-limiting examples of such residues are multiple histidine residues, glutatione residues and a myc-tag such as AAAEQKLISEEDLNGAA [SEQ ID NO:31];

e) may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the Nanobodies of the invention.

According to another embodiment, a polypeptide of the invention comprises a Nanobody of the invention, which is fused at its amino terminal end, at its carboxy terminal end, or both at its amino terminal end and at its carboxy terminal end to at least one further amino acid sequence, i.e. so as to provide a fusion protein comprising said Nanobody of the invention and the one or more further amino acid sequences. Such a fusion will also be referred to herein as a "Nanobody fusion".

The one or more further amino acid sequence may be any suitable and/or desired amino acid sequences. The further amino acid sequences may or may not change, alter or otherwise influence the (biological) properties of the Nanobody, and may or may not add further functionality to the Nanobody or the polypeptide of the invention. Preferably, the further amino acid sequence is such that it confers one or more desired properties or functionalities to the Nanobody or the polypeptide of the invention.

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005), For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the Nanobody of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

The further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the Nanobody of the invention is directed, or a different protein, polypeptide, antigen, antigenic determinant or epitope). For example, the further amino acid sequence may provide a second binding site that is directed against a serum protein (such as, for example, human serum albumin or another serum protein such as IgG), so as to provide increased half-life in serum. Reference is for example made to EP 0 368 684, WO 91/01743, WO 01/45746 and WO 04/003019 (in which various serum proteins are mentioned), the International application by Ablynx N.V. entitled "Nanobodies against amyloid-beta and polypeptides comprising the same for the treatment of degenerative neural diseases such as Alzheimer's disease" (in which various other proteins are mentioned), as well as to Harmsen et al., Vaccine, 23 (41); 4926-42, 2005.

According to another embodiment, the one or more further amino acid sequences may comprise one or more parts, fragments or domains of conventional 4-chain antibodies (and in particular human antibodies) and/or of heavy chain antibodies. For example, although usually less preferred, a Nanobody of the invention may be linked to a conventional (preferably human) $V_H$ or $V_L$ domain domain or to a natural or synthetic analog of a $V_H$ or $V_L$ domain, again optionally via a linker sequence (including but not limited to other (single) domain antibodies, such as the dAb's described by Ward et al.).

In one specific aspect of the invention, a Nanobody of the invention or a compound, construct or polypeptide of the invention comprising at least one Nanobody of the invention may have an increased half-life, compared to the corresponding amino acid sequence of the invention. Some preferred, but non-limiting examples of such Nanobodies, compounds and polypeptides will become clear to the skilled person based on the further disclosure herein, and for example comprise Nanobodies sequences or polypeptides of the invention that have been chemically modified to increase the half-life thereof (for example, by means of pegylation); amino acid sequences of the invention that comprise at least one additional binding site for binding to a serum protein (such as serum albumin. Reference is for example made to the US provisional application by Ablynx N.V. entitled "Immunoglobulin domains with multiple binding sites" filed on Nov. 27, 2006); or polypeptides of the invention that comprise at least one Nanobody of the invention that is linked to at least one moiety (and in particular at least one amino acid sequence) that increases the half-life of the Nanobody of the invention. Examples of polypeptides of the invention that comprise such half-life extending moieties or amino acid sequences will become clear to the skilled person based on the further disclosure herein; and for example include, without limitation, polypeptides in which the one or more Nanobodies of the invention are suitable linked to one or more serum proteins or fragments thereof (such as serum albumin or suitable fragments thereof) or to one or more binding units that can bind to serum proteins (such as, for example, Nanobodies or (single) domain antibodies that can bind to serum proteins such as serum albumin, serum immunoglobulins such as IgG, or transferrine); polypeptides in which a Nanobody of the invention is linked to an Fc portion (such as a human Fc) or a suitable part or fragment thereof; or polypeptides in which the one or more Nanobodies of the invention are suitable linked to one or more small proteins or peptides that can bind to serum proteins (such as, without limitation, the proteins and peptides described in WO 91/01743, WO 01/45746, WO 02/076489).

Generally, the Nanobodies of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the Nanobodies, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such Nanobodies, compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), at preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) Nanobodies of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) Nanobodies, such as the Nanobodies described in WO 02/057445, of which FC44 (SEQ ID NO: 189 of WO 06/040153) and FC5 (SEQ ID NO: 190 of WO 06/040154) are preferred examples.

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the Nanobody of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the Nanobody of the invention may be linked to a fragment of serum albumin that at least comprises the domain III of serum albumin or part thereof. Reference is for example made to the U.S. provisional application 60/788,256 of Ablynx N.V. entitled "Albumin derived amino acid sequence, use thereof for increasing the half-life of therapeutic proteins and of other therapeutic proteins and entities, and constructs comprising the same" filed on Mar. 31, 2006.

Some preferred, but non-limiting, examples of fusions of anti-IL6R Nanobodies to human serum albumin are given in SEQ ID NO's: 603-608.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, as well as to EP 0 368 684, as well as to the following the U.S. provisional applications 60/843, 349, 60/850,774, 60/850,775 by Ablynx N.V. mentioned herein.

Such amino acid sequences may in particular be directed against serum albumin (and more in particular human serum albumin) and/or against IgG (and more in particular human IgG). For example, such amino acid sequences may be amino acid sequences that are directed against (human) serum albumin and that amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again see for example WO 06/0122787); amino acid sequences that have or can provide an increased half-life (see for example the U.S. provisional application 60/843,349 by Ablynx N.V. entitled "Serum albumin binding proteins with long half-lives" filed on Sep. 8, 2006); amino acid sequences against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*), reference is again made to the U.S. provisional application 60/843,349); amino acid sequences that can bind to serum albumin in a pH independent manner (see for example the U.S. provisional application 60/850,774 by Ablynx N.V. entitled "Amino acid sequences that bind to serum proteins in a manner that is essentially independent of the pH, compounds comprising the same, and uses thereof", filed on Oct. 11, 2006) and/or amino acid sequences that are conditional binders (see for example the U.S. provisional application 60/850,775 by Ablynx N.V. entitled "Amino acid sequences that bind to a desired molecule in a conditional manner", filed on Oct. 11, 2006).

The at least one Nanobody may also be linked to one or more (preferably human) $CH_1$, $CH_2$ and/or $CH_3$ domains, optionally via a linker sequence. For instance, a Nanobody linked to a suitable $CH_1$ domain could for example be used—together with suitable light chains—to generate antibody fragments/structures analogous to conventional Fab fragments or F(ab')2 fragments, but in which one or (in case of an F(ab')2 fragment) one or both of the conventional $V_H$ domains have been replaced by a Nanobody of the invention. Also, two Nanobodies could be linked to a CH3 domain (optionally via a linker) to provide a construct with increased half-life in vivo.

According to one specific embodiment of a polypeptide of the invention, one or more Nanobodies of the invention may be linked to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $CH_2$ and/or $CH_3$ domains of an antibody, such as from a heavy chain antibody (as described herein) and more preferably from a conventional human 4-chain antibody; and/or may form (part of) and Fc region, for example from IgG, from IgE or from another human Ig. For example, WO 94/04678 describes heavy chain antibodies comprising a Camelid $V_{HH}$ domain or a humanized derivative thereof (i.e. a Nanobody), in which the Camelidae $CH_2$ and/or $CH_3$ domain have been replaced by human $CH_2$ and $CH_3$ domains, so as to provide an immunoglobulin that consists of 2 heavy chains each comprising a Nanobody and human CH2 and CH3 domains (but no CH1 domain), which immunoglobulin has the effector function provided by the CH2 and CH3 domains and which immunoglobulin can function without the presence of any light chains. Other amino acid sequences that can be suitably linked to the Nanobodies of the invention so as to provide an effector function will be clear to the skilled person, and may be chosen on the basis of the desired effector function(s). Reference is for example made to WO 04/058820, WO 99/42077 and WO 05/017148, as well as the review by Holliger and Hudson, supra. Coupling of a Nanobody of the invention to an Fc portion may also lead to an increased half-life, compared to the corresponding Nanobody of the invention. For some applications, the use of an Fc portion and/or of constant domains (i.e. $CH_2$ and/or $CH_3$ domains) that confer increased half-life without any biologically significant effector function may also be suitable or even preferred. Other suitable constructs comprising one or more Nanobodies and one or more constant domains with increased half-life in vivo will be clear to the skilled person, and may for example comprise two Nanobodies linked to a CH3 domain, optionally via a linker sequence. Generally, any fusion protein or derivatives with increased half-life will preferably have a molecular weight of more than 50 kD, the cut-off value for renal absorption.

The further amino acid sequences may also form a signal sequence or leader sequence that directs secretion of the Nanobody or the polypeptide of the invention from a host cell upon synthesis (for example to provide a pre-, pro- or preproform of the polypeptide of the invention, depending on the host cell used to express the polypeptide of the invention).

The further amino acid sequence may also form a sequence or signal that allows the Nanobody or polypeptide of the invention to be directed towards and/or to penetrate or enter into specific organs, tissues, cells, or parts or compartments of cells, and/or that allows the Nanobody or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, the "Peptrans" vectors mentioned above, the sequences described by Cardinale et al. and the amino acid sequences and antibody fragments known per se that can be used to express or produce the Nanobodies and polypeptides of the invention as so-called "intrabodies", for example as described in WO 94/02610, WO 95/22618, U.S. Pat. No. 7,004,940, WO 03/014960, WO 99/07414; WO 05/01690; EP 1 512 696; and in Cattaneo, A. & Biocca, S. (1997) Intracellular Antibodies: Development and Applications. Landes and Springer-Verlag; and in Kontermann, Methods 34, (2004), 163-170, and the further references described therein.

For some applications, in particular for those applications in which it is intended to kill a cell that expresses the target against which the Nanobodies of the invention are directed (e.g. in the treatment of cancer), or to reduce or slow the growth and/or proliferation of such a cell, the Nanobodies of the invention may also be linked to a (cyto)toxic protein or polypeptide. Examples of such toxic proteins and polypeptides which can be linked to a Nanobody of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting embodiment, said one or more further amino acid sequences comprise at least one further Nanobody, so as to provide a polypeptide of the invention that comprises at least two, such as three, four, five or more Nanobodies, in which said Nanobodies may optionally be linked via one or more linker sequences (as defined herein). Polypeptides of the invention that comprise two or more Nanobodies, of which at least one is a Nanobody of the invention, will also be referred to herein as "multivalent" polypeptides of the invention, and the Nanobodies present in such polypeptides will also be referred to herein as being in a "multivalent format". For example a "bivalent" polypeptide of the invention comprises two Nanobodies, optionally linked via a linker sequence, whereas a "trivalent" polypeptide of the invention comprises three Nanobodies, optionally linked via two linker sequences; etc.; in which at least one of the Nanobodies present in the polypeptide, and up to all of the Nanobodies present in the polypeptide, is/are a Nanobody of the invention.

In a multivalent polypeptide of the invention, the two or more Nanobodies may be the same or different, and may be directed against the same antigen or antigenic determinant (for example against the same part(s) or epitope(s) or against different parts or epitopes) or may alternatively be directed against different antigens or antigenic determinants; or any suitable combination thereof. For example, a bivalent polypeptide of the invention may comprise (a) two identical Nanobodies; (b) a first Nanobody directed against a first antigenic determinant of a protein or antigen and a second Nanobody directed against the same antigenic determinant of said protein or antigen which is different from the first Nanobody; (c) a first Nanobody directed against a first antigenic determinant of a protein or antigen and a second Nanobody directed against another antigenic determinant of said protein or antigen; or (d) a first Nanobody directed against a first protein or antigen and a second Nanobody directed against a second protein or antigen (i.e. different from said first antigen). Similarly, a trivalent polypeptide of the invention may, for example and without being limited thereto. comprise (a) three identical Nanobodies; (b) two identical Nanobody against a first antigenic determinant of an antigen and a third Nanobody directed against a different antigenic determinant of the same antigen; (c) two identical Nanobody against a first antigenic determinant of an antigen and a third Nanobody directed against a second antigen different from said first antigen; (d) a first Nanobody directed against a first antigenic determinant of a first antigen, a second Nanobody directed against a second antigenic determinant of said first antigen and a third Nanobody directed against a second antigen different from said first antigen; or (e) a first Nanobody directed against a first antigen, a second Nanobody directed against a second antigen different from said first antigen, and a third Nanobody directed against a third antigen different from said first and second antigen.

Polypeptides of the invention that contain at least two Nanobodies, in which at least one Nanobody is directed against a first antigen (i.e. against the IL-6 receptor) and at least one Nanobody is directed against a second antigen (i.e. different from the IL-6 receptor), will also be referred to as "multispecific" polypeptides of the invention, and the Nanobodies present in such polypeptides will also be referred to herein as being in a "multispecific format". Thus, for example, a "bispecific" polypeptide of the invention is a polypeptide that comprises at least one Nanobody directed against a first antigen (i.e. the IL-6 receptor) and at least one further Nanobody directed against a second antigen (i.e. different from the IL-6 receptor), whereas a "trispecific" polypeptide of the invention is a polypeptide that comprises at least one Nanobody directed against a first antigen (i.e. the IL-6 receptor), at least one further Nanobody directed against a second antigen (i.e. different from the IL-6 receptor) and at least one further Nanobody directed against a third antigen (i.e. different from both the IL-6 receptor, and the second antigen); etc.

Accordingly, in its simplest form, a bispecific polypeptide of the invention is a bivalent polypeptide of the invention (as defined herein), comprising a first Nanobody directed against the IL-6 receptor, and a second Nanobody directed against a second antigen, in which said first and second Nanobody may optionally be linked via a linker sequence (as defined herein); whereas a trispecific polypeptide of the invention in its simplest form is a trivalent polypeptide of the invention (as defined herein), comprising a first Nanobody directed against the IL-6 receptor, a second Nanobody directed against a second antigen and a third Nanobody directed against a third antigen, in which said first, second and third Nanobody may optionally be linked via one or more, and in particular one and more in particular two, linker sequences.

Some preferred, but non-limiting examples of bivalent bispecific polypeptides of the invention are given in SEQ ID NO's: 450-471 and 559-602. Some preferred, but non-limiting examples of trivalent bispecific polypeptides of the invention are given in SEQ ID NO's: 478-558.

However, as will be clear from the description hereinabove, the invention is not limited thereto, in the sense that a multispecific polypeptide of the invention may comprise at least one Nanobody against the IL-6 receptor, and any number of Nanobodies directed against one or more antigens different from the IL-6 receptor.

Furthermore, although it is encompassed within the scope of the invention that the specific order or arrangement of the various Nanobodies in the polypeptides of the invention may have some influence on the properties of the final polypeptide of the invention (including but not limited to the affinity, specificity or avidity for the IL-6 receptor, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies, unless explicitly indicated otherwise.

Finally, it is also within the scope of the invention that the polypeptides of the invention contain two or more Nanobodies and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one Nanobody of the invention and at least one Nanobody that provides for an increased half-life. Some preferred, but non-limiting examples of such Nanobodies include Nanobodies directed against serum proteins, such as human serum albumin, thyroxine-binding protein, (human) transferrin, fibrinogen, an immunoglobulin such as IgG, IgE or IgM, or one of the other serum proteins listed in WO 04/003019.

For example, for experiments in mice, Nanobodies against mouse serum albumin (MSA) can be used, whereas for pharmaceutical use, Nanobodies against human serum albumin can be used.

Another embodiment of the present invention is a polypeptide construct as described above wherein said at least one (human) serum protein is any of (human) serum albumin, (human) serum immunoglobulins, (human) thyroxine-binding protein, (human) transferrin, (human) fibrinogen, etc.

According to a specific, but non-limiting aspect of the invention, the polypeptides of the invention contain, besides the one or more Nanobodies of the invention, at least one Nanobody against human serum albumin. Although these Nanobodies against human serum albumin may be as generally described in the applications by Ablynx N.V. cited above (see for example WO04/062551), according to a particularly preferred, but non-limiting embodiment, said Nanobody against human serum albumin consists of 4 framework regions (FR1 to FR4 respectively) and 3 complementarity determining regions (CDR1 to CDR3 respectively), in which:

i) CDR1 is an amino acid sequence chosen from the group consisting of:

| SFGMS | [SEQ ID NO: 15] |
|---|---|
| LNLMG | [SEQ ID NO: 16] |
| INLLG | [SEQ ID NO: 17] |
| NYWMY; | [SEQ ID NO: 18] | and/or from the group consisting of amino acid sequences that have 2 or only 1 "amino acid difference(s)" (as defined herein) with one of the above amino acid sequences, in which:

(1) any amino acid substitution is preferably a conservative amino acid substitution (as defined herein); and/or (2) said amino acid sequence preferably only contains amino acid substitutions, and no amino acid deletions or insertions, compared to the above amino acid sequences;

and in which:

ii) CDR2 is an amino acid sequence chosen from the group consisting of:

| SISGSGSDTLYADSVKG | [SEQ ID NO: 19] |
|---|---|
| TITVGDSTNYADSVKG | [SEQ ID NO: 20] |

-continued

```
TITVGDSTSYADSVKG      [SEQ ID NO: 21]

SINGRGDDTRYADSVKG     [SEQ ID NO: 22]

AISADSSTKNYADSVKG     [SEQ ID NO: 23]

AISADSSDKRYADSVKG     [SEQ ID NO: 24]

RISTGGGYSYYADSVKG     [SEQ ID NO: 25]
``` or from the group consisting of amino acid sequences that have at least 80%, preferably at least 90%, more preferably at least 95%, even more preferably at least 99% sequence identity (as defined herein) with one of the above amino acid sequences; in which (1) any amino acid substitution is preferably a conservative amino acid substitution (as defined herein); and/or (2) said amino acid sequence preferably only contains amino acid substitutions, and no amino acid deletions or insertions, compared to the above amino acid sequences;

and/or from the group consisting of amino acid sequences that have 3, 2 or only 1 "amino acid difference(s)" (as defined herein) with one of the above amino acid sequences, in which:

(1) any amino acid substitution is preferably a conservative amino acid substitution (as defined herein); and/or (2) said amino acid sequence preferably only contains amino acid substitutions, and no amino acid deletions or insertions, compared to the above amino acid sequences;

and in which:

iii) CDR3 is an amino acid sequence chosen from the group consisting of:

```
DREAQVDTLDFDY         [SEQ ID NO: 26]
``` or from the group consisting of amino acid sequences that have at least 80%, preferably at least 90%, more preferably at least 95%, even more preferably at least 99% sequence identity (as defined herein) with one of the above amino acid sequences; in which (1) any amino acid substitution is preferably a conservative amino acid substitution (as defined herein); and/or (2) said amino acid sequence preferably only contains amino acid substitutions, and no amino acid deletions or insertions, compared to the above amino acid sequences;

and/or from the group consisting of amino acid sequences that have 3, 2 or only 1 "amino acid difference(s)" (as defined herein) with one of the above amino acid sequences, in which:

(1) any amino acid substitution is preferably a conservative amino acid substitution (as defined herein); and/or (2) said amino acid sequence preferably only contains amino acid substitutions, and no amino acid deletions or insertions, compared to the above amino acid sequences;

or from the group consisting of:

```
GGSLSR                [SEQ ID NO: 27]

RRTWHSEL              [SEQ ID NO: 28]

GRSVSRS               [SEQ ID NO: 29]

GRGSP                 [SEQ ID NO: 30]
``` and/or from the group consisting of amino acid sequences that have 3, 2 or only 1 "amino acid difference(s)" (as defined herein) with one of the above amino acid sequences, in which:

(1) any amino acid substitution is preferably a conservative amino acid substitution (as defined herein); and/or (2) said amino acid sequence preferably only contains amino acid substitutions, and no amino acid deletions or insertions, compared to the above amino acid sequences.

In another aspect, the invention relates to a Nanobody against human serum albumin, which consist of 4 framework regions (FR1 to FR4 respectively) and 3 complementarity determining regions (CDR1 to CDR3 respectively), which is chosen from the group consisting of Nanobodies with the one of the following combinations of CDR1, CDR2 and CDR3, respectively:

CDR1: SFGMS; CDR2: SISGSGSDTLYADSVKG; CDR3: GGSLSR;

CDR1: LNLMG; CDR2: TITVGDSTNYADSVKG; CDR3: RRTWHSEL;

CDR1: INLLG; CDR2: TITVGDSTSYADSVKG; CDR3: RRTWHSEL;

CDR1: SFGMS; CDR2: SINGRGDDTRYADSVKG; CDR3: GRSVSRS;

CDR1: SFGMS; CDR2: AISADSSDKRYADSVKG; CDR3: GRGSP;

CDR1: SFGMS; CDR2: AISADSSDKRYADSVKG; CDR3: GRGSP;

CDR1: NYWMY; CDR2: RISTGGGYSYYADSVKG; CDR3: DREAQVDTLDFDY.

In the Nanobodies of the invention that comprise the combinations of CDR's mentioned above, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which (1) any amino acid substitution is preferably a conservative amino acid substitution (as defined herein); and/or (2) said amino acid sequence preferably only contains amino acid substitutions, and no amino acid deletions or insertions, compared to the above amino acid sequences;

and/or chosen from the group consisting of amino acid sequences that have 3, 2 or only 1 (as indicated in the preceding paragraph) "amino acid difference(s)" (as defined herein) with the mentioned CDR(s) one of the above amino acid sequences, in which:

(1) any amino acid substitution is preferably a conservative amino acid substitution (as defined herein); and/or (2) said amino acid sequence preferably only contains amino acid substitutions, and no amino acid deletions or insertions, compared to the above amino acid sequences.

However, of the Nanobodies of the invention that comprise the combinations of CDR's mentioned above, Nanobodies comprising one or more of the CDR's listed above are particularly preferred; Nanobodies comprising two or more of the CDR's listed above are more particularly preferred; and Nanobodies comprising three of the CDR's listed above are most particularly preferred.

In these Nanobodies against human serum albumin, the Framework regions FR1 to FR4 are preferably as defined hereinabove for the Nanobodies of the invention.

Some preferred, but non-limiting examples of Nanobodies directed against human serum albumin that can be used in the polypeptides of the invention are listed in Table A-9 below. ALB-8 is a humanized version of ALB-1.

TABLE A-9

Preferred, but non-limiting examples of albumin-binding Nanobodies
<Name, SEQ ID #; PRT (protein); ->
Sequence <PMP 6A6(ALB-1), SEQ ID NO: 32; PRT; ->
AVQLVESGGGLVQPGNSLRLSCAASGFTFRSFGMSWVRQAPGKEPEWVSSISGSGSDTLYADSVKG
RFTISRDNAKTTLYLQMNSLKPEDTAVYYCTIGGSLSRSSQGTQVTVSS <ALB-8(humanized ALB-1), SEQ ID NO: 33; PRT; ->
EVQLVESGGGLVQPGNSLRLSCAASGFTFSSFGMSWVRQAPGKGLEWVSSISGSGSDTLYADSVKG
RFTISRDNAKTTLYLQMNSLRPEDTAVYYCTIGGSLSRSSQGTLVTVSS <PMP 6A8(ALB-2), SEQ ID NO: 34; PRT; ->
AVQLVESGGGLVQGGGSLRLACAASERIFDLNLMGWYRQGPGNERELVATCITVGDSTNYADSVKG
RFTISMDYTKQTVYLHMNSLRPEDTGLYYCKIRRTWHSELWGQGTQVTVSS Some preferred, but non-limiting examples of polypeptides of the invention that comprise at least one Nanobody against IL-6R and at least one Nanobody that provides for increased half-life are given in SEQ ID NO's 478 to 602.

Generally, any derivatives and/or polypeptides of the invention with increased half-life (for example pegylated Nanobodies or polypeptides of the invention, multispecific Nanobodies directed against the IL-6 receptor and (human) serum albumin, or Nanobodies fused to an Fc portion, all as described herein) have a half-life that is at least 1.5 times, preferably at least 2 times, such as at least 5 times, for example at least 10 times or more than 20 times, the half-life of the corresponding Nanobody of the invention.

Also, any derivatives or polypeptides of the invention with an increase half-life preferably have a half-life of more than 1 hour, preferably more than 2 hours, more preferably of more than 6 hours, such as of more than 12 hours, and for example of about one day, two days, one week, two weeks or three weeks, and preferably no more than 2 months, although the latter may be less critical.

Half-life can generally be defined as the time taken for the serum concentration of the polypeptide to be reduce by 50%, in vivo, for example due to degradation of the ligand and/or clearance or sequestration of the ligand by natural mechanisms. Methods for pharmacokinetic analysis and determination of half-life are familiar to those skilled in the art. Details may be found in Kenneth, A et al: Chemical Stability of Pharmaceuticals: A Handbook for Pharmacists and in Peters et al, Pharmacokinete analysis: A Practical Approach (1996). Reference is also made to "Pharmacokinetics", M Gibaldi & D Perron, published by Marcel Dekker, 2 nd Rev. ex edition (1982).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multispecific polypeptide of the invention comprises at least one Nanobody of the invention and at least one Nanobody that directs the polypeptide of the invention towards, and/or that allows the polypeptide of the invention to penetrate or to enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such Nanobodies include Nanobodies that are directed towards specific cell-surface proteins, markers or epitopes of the desired organ, tissue or cell (for example cell-surface markers associated with tumor cells), and the single-domain brain targeting antibody fragments described in WO 02/057445, of which FC44 (SEQ ID NO 35) and FC5 (SEQ ID NO: 36) are preferred examples.

TABLE A-10

Sequence listing of FC44 and FC5
<Name, SEQ ID #; PRT (protein); ->
Sequence

< FC44, SEQ ID NO: 35; PRT; ->
EVQLQASGGGLVQAGGSLRLSCSASVRTFSIYAMGWFRQAPGKEREFVAGINRSGDVTKYADFVKG
RFSISRDNAKNMVYLQMNSLKPEDTALYYCAATWAYDTVGALTSGYNFWGQGTQVTVSS

< FC5, SEQ ID NO: 36; PRT; ->
EVQLQASGGGLVQAGGSLRLSCAASGFKITHYTMGWFRQAPGKEREFVSRITWGGDNTFYSNSVKG
RFTISRDNAKNTVYLQMNSLKPEDTADYYCAAGSTSTATPLRVDYWGKGTQVTVSS

In the polypeptides of the invention, the one or more Nanobodies and the one or more polypeptides may be directly linked to each other (as for example described in WO 99/23221) and/or may be linked to each other via one or more suitable spacers or linkers, or any combination thereof.

Suitable spacers or linkers for use in multivalent and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each Nanobody by itself forms a complete antigen-binding site).

For example, a linker may be a suitable amino acid sequence, and in particular amino acid sequences of between 1 and 50, preferably between 1 and 30, such as between 1 and 10 amino acid residues. Some preferred examples of such amino acid sequences include gly-ser linkers, for example of the type $(gly_x ser_y)_z$, such as (for example $(gly_4 ser)_3$ or $(gly_3 ser_2)_3$, as described in WO 99/42077, hinge-like regions such as the hinge regions of naturally occurring heavy chain antibodies or similar sequences (such as described in WO 94/04678).

Some other particularly preferred linkers are poly-alanine (such as AAA), as well as the linkers mentioned in Table A-11, of which AAA, GS-7 and GS-9 are particularly preferred.

TABLE A-11

Sequence listing of linkers
<Name, SEQ ID #; PRT (protein); ->
Sequence

< GS30, SEQ ID NO: 37; PRT; ->
GGGGSGGGSGGGGSGGGGSGGGGSGGGGS

< GS15, SEQ ID NO: 38; PRT; ->
GGGGSGGGGSGGGGS

< GS9, SEQ ID NO: 39; PRT; ->
GGGGSGGGS

< GS7, SEQ ID NO: 40; PRT; ->
SGGSGGS

< Llama upper long hinge region, SEQ ID NO: 41;
PRT; -> EPKTPKPQPAAA

Other suitable linkers generally comprise organic compounds or polymers, in particular those suitable for use in proteins for pharmaceutical use. For instance, poly(ethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for The IL-6 receptor, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise Nanobodies directed against a multimeric antigen (such as a multimeric receptor or other protein), the length and flexibility of the linker are preferably such that it allows each Nanobody of the invention present in the polypeptide to bind to the antigenic determinant on each of the subunits of the multimer. Similarly, in a multispecific polypeptide of the invention that comprises Nanobodies directed against two or more different antigenic determinants on the same antigen (for example against different epitopes of an antigen and/or against different subunits of a multimeric receptor, channel or protein), the length and flexibility of the linker are preferably such that it allows each Nanobody to bind to its intended antigenic determinant. Again, based on the disclosure herein, the skilled person will be able to determine the optimal linker(s) for use in a specific polypeptide of the invention, optionally after some limited routine experiments.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies of the invention). For example, linkers containing one or more charged amino acid residues (see Table A-2 above) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thereto. For example, when a polypeptide of the invention comprises three of more Nanobodies, it is possible to link them by use of a linker with three or more "arms", which each "arm" being linked to a Nanobody, so as to provide a "star-shaped" construct. It is also possible, although usually less preferred, to use circular constructs.

The invention also comprises derivatives of the polypeptides of the invention, which may be essentially analogous to the derivatives of the Nanobodies of the invention, i.e. as described herein.

The invention also comprises proteins or polypeptides that "essentially consist" of a polypeptide of the invention (in which the wording "essentially consist of" has essentially the same meaning as indicated hereinabove).

According to one embodiment of the invention, the polypeptide of the invention is in essentially isolated from, as defined herein.

The amino acid sequences, Nanobodies, polypeptides and nucleic acids of the invention can be prepared in a manner known per se, as will be clear to the skilled person from the further description herein. For example, the Nanobodies and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, Nanobodies, polypeptides and nucleic acids include the methods and techniques described herein.

As will be clear to the skilled person, one particularly useful method for preparing an amino acid sequence, Nanobody and/or a polypeptide of the invention generally comprises the steps of:

the expression, in a suitable host cell or host organism (also referred to herein as a "host of the invention") or in another suitable expression system of a nucleic acid that encodes said amino acid sequence, Nanobody or polypeptide of the invention (also referred to herein as a "nucleic acid of the invention"), optionally followed by:

isolating and/or purifying the amino acid sequence, Nanobody or polypeptide of the invention thus obtained.

In particular, such a method may comprise the steps of:

cultivating and/or maintaining a host of the invention under conditions that are such that said host of the invention expresses and/or produces at least one amino acid sequence, Nanobody and/or polypeptide of the invention; optionally followed by:

isolating and/or purifying the amino acid sequence, Nanobody or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one embodiment of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring GPCR ???? as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art. Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting embodiment, a genetic construct of the invention comprises a) at least one nucleic acid of the invention; operably connected to b) one or more regulatory elements, such as a promoter and optionally a suitable terminator;

and optionally also c) one or more further elements of genetic constructs known per se;

in which the terms "regulatory element", "promoter", "terminator" and "operably connected" have their usual meaning in the art (as further described herein); and in which said "further elements" present in the genetic constructs may for example be 3'- or 5'-UTR sequences, leader sequences, selection markers, expression markers/reporter genes, and/or elements that may facilitate or increase (the efficiency of) transformation or integration. These and other suitable elements for such genetic constructs will be clear to the skilled person, and may for instance depend upon the type of construct used, the intended host cell or host organism; the manner in which the nucleotide sequences of the invention of interest are to be expressed (e.g. via constitutive, transient or inducible expression); and/or the transformation technique to be used. For example, regulatory sequences, promoters and terminators known per se for the expression and production of antibodies and antibody fragments (including but not limited to (single) domain antibodies and ScFv fragments) may be used in an essentially analogous manner.

Preferably, in the genetic constructs of the invention, said at least one nucleic acid of the invention and said regulatory elements, and optionally said one or more further elements, are "operably linked" to each other, by which is generally meant that they are in a functional relationship with each other. For instance, a promoter is considered "operably linked" to a coding sequence if said promoter is able to initiate or otherwise control/regulate the transcription and/or the expression of a coding sequence (in which said coding sequence should be understood as being "under the control of" said promotor). Generally, when two nucleotide sequences are operably linked, they will be in the same orientation and usually also in the same reading frame. They will usually also be essentially contiguous, although this may also not be required.

Preferably, the regulatory and further elements of the genetic constructs of the invention are such that they are capable of providing their intended biological function in the intended host cell or host organism.

For instance, a promoter, enhancer or terminator should be "operable" in the intended host cell or host organism, by which is meant that (for example) said promoter should be capable of initiating or otherwise controlling/regulating the transcription and/or the expression of a nucleotide sequence—e.g. a coding sequence—to which it is operably linked (as defined herein).

Some particularly preferred promoters include, but are not limited to, promoters known per se for the expression in the host cells mentioned herein; and in particular promoters for the expression in the bacterial cells, such as those mentioned herein and/or those used in the Examples.

A selection marker should be such that it allows—i.e. under appropriate selection conditions—host cells and/or host organisms that have been (successfully) transformed with the nucleotide sequence of the invention to be distinguished from host cells/organisms that have not been (successfully) transformed. Some preferred, but non-limiting examples of such markers are genes that provide resistance against antibiotics (such as kanamycin or ampicillin), genes that provide for temperature resistance, or genes that allow the host cell or host organism to be maintained in the absence of certain factors, compounds and/or (food) components in the medium that are essential for survival of the non-transformed cells or organisms.

A leader sequence should be such that—in the intended host cell or host organism—it allows for the desired post-translational modifications and/or such that it directs the transcribed mRNA to a desired part or organelle of a cell. A leader sequence may also allow for secretion of the expression product from said cell. As such, the leader sequence may be any pro-, pre-, or prepro-sequence operable in the host cell or host organism. Leader sequences may not be required for expression in a bacterial cell. For example, leader sequences known per se for the expression and production of antibodies and antibody fragments (including but not limited to single domain antibodies and ScFv fragments) may be used in an essentially analogous manner.

An expression marker or reporter gene should be such that—in the host cell or host organism—it allows for detection of the expression of (a gene or nucleotide sequence present on) the genetic construct. An expression marker may optionally also allow for the localisation of the expressed product, e.g. in a specific part or organelle of a cell and/or in (a) specific cell(s), tissue(s), organ(s) or part(s) of a multicellular organism. Such reporter genes may also be expressed as a protein fusion with the amino acid sequence of the invention. Some preferred, but non-limiting examples include fluorescent proteins such as GFP.

Some preferred, but non-limiting examples of suitable promoters, terminator and further elements include those that can be used for the expression in the host cells mentioned herein; and in particular those that are suitable for expression in bacterial cells, such as those mentioned herein and/or those used in the Examples below. For some (further) non-limiting examples of the promoters, selection markers, leader sequences, expression markers and further elements that may be present/used in the genetic constructs of the invention—such as terminators, transcriptional and/or translational enhancers and/or integration factors—reference is made to the general handbooks such as Sambrook et al. and Ausubel et al. mentioned above, as well as to the examples that are given in WO 95/07463, WO 96/23810, WO 95/07463, WO 95/21191, WO 97/11094, WO 97/42320, WO 98/06737, WO 98/21355, U.S. Pat. No. 7,207,410, U.S. Pat. No. 5,693,492 and EP 1 085 089. Other examples will be clear to the skilled person. Reference is also made to the general background art cited above and the further references cited herein.

The genetic constructs of the invention may generally be provided by suitably linking the nucleotide sequence(s) of the invention to the one or more further elements described above, for example using the techniques described in the general handbooks such as Sambrook et al. and Ausubel et al., mentioned above.

Often, the genetic constructs of the invention will be obtained by inserting a nucleotide sequence of the invention in a suitable (expression) vector known per se. Some preferred, but non-limiting examples of suitable expression vectors are those used in the Examples below, as well as those mentioned herein.

The nucleic acids of the invention and/or the genetic constructs of the invention may be used to transform a host cell or host organism, i.e. for expression and/or production of the amino acid sequence, Nanobody or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example:

a bacterial strain, including but not limited to gram-negative strains such as strains of *Escherichia coli*; of *Proteus*, for example of *Proteus mirabilis*; of *Pseudomonas*, for example of *Pseudomonas fluorescens*; and gram-positive strains such as strains of *Bacillus*, for example of *Bacillus subtilis* or of *Bacillus brevis*; of *Streptomyces*, for example of *Streptomyces lividans*; of *Staphylococcus*, for example of *Staphylococcus carnosus*; and of *Lactococcus*, for example of *Lactococcus lactis*;

a fungal cell, including but not limited to cells from species of *Trichoderma*, for example from *Trichoderma reesei*; of *Neurospora*, for example from *Neurospora crassa*; of *Sordaria*, for example from *Sordaria macrospora*; of *Aspergillus*, for example from *Aspergillus niger* or from *Aspergillus sojae*; or from other filamentous fungi;

a yeast cell, including but not limited to cells from species of *Saccharomyces*, for example of *Saccharomyces cerevisiae*; of *Schizosaccharomyces*, for example of *Schizosaccharomyces pombe*; of *Pichia*, for example of *Pichia pastoris* or of *Pichia methanolica*; of *Hansenula*, for example of *Hansenula polymorpha*; of *Kluyveromyces*, for example of *Kluyveromyces lactis*; of *Arxula*, for example of *Arxula adeninivorans*; of *Yarrowia*, for example of *Yarrowia lipolytica*;

an amphibian cell or cell line, such as *Xenopus oocytes*;

an insect-derived cell or cell line, such as cells/cell lines derived from *lepidoptera*, including but not limited to *Spodoptera* SF9 and Sf21 cells or cells/cell lines derived from *Drosophila*, such as Schneider and Kc cells;

a plant or plant cell, for example in tobacco plants; and/or a mammalian cell or cell line, for example a cell or cell line derived from a human, a cell or a cell line from mammals including but not limited to CHO-cells, BHK-cells (for example BHK-21 cells) and human cells or cell lines such as HeLa, COS (for example COS-7) and PER.C6 cells;

as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies and polypeptides of the invention can also be introduced and expressed in one or more cells, tissues or organs of a multicellular organism, for example for prophylactic and/or therapeutic purposes (e.g. as a gene therapy). For this purpose, the nucleotide sequences of the invention may be introduced into the cells or tissues in any suitable way, for example as such (e.g. using liposomes) or after they have been inserted into a suitable gene therapy vector (for example derived from retroviruses such as adenovirus, or parvoviruses such as adeno-associated virus). As will also be clear to the skilled person, such gene therapy may be performed in vivo and/or in situ in the body of a patient by administering a nucleic acid of the invention or a suitable gene therapy vector encoding the same to the patient or to specific cells or a specific tissue or organ of the patient; or suitable cells (often taken from the body of the patient to be treated, such as explanted lymphocytes, bone marrow aspirates or tissue biopsies) may be treated in vitro with a nucleotide sequence of the invention and then be suitably (re-) introduced into the body of the patient. All this can be performed using gene therapy vectors, techniques and delivery systems which are well known to the skilled person, and for example described in Culver, K. W., "Gene Therapy", 1994, p. xii, Mary Ann Liebert, Inc., Publishers, New York, N.Y.); Giordano, Nature F Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91; (1998), 30-36; Verma, Gene Ther. 5 (1998), 692-699; Nabel, Ann. N.Y. Acad. Sci.: 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. Nos. 5,580,859; 55,895,466; or Schaper, Current Opinion in Biotechnology 7 (1996), 635-640. For example, in situ expression of ScFv fragments (Afanasieva et al., Gene Ther., 10, 1850-1859 (2003)) and of diabodies (Blanco et al., J. Immunol, 171, 1070-1077 (2003)) has been described in the art.

For expression of the Nanobodies in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, Nanobodies and polypeptides of the invention can for example also be produced in the milk of transgenic mammals, for example in the milk of rabbits, cows, goats or sheep (see for example U.S. Pat. Nos. 6,741, 957, 6,304,489 and 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bombix mori*.

Furthermore, the amino acid sequences, Nanobodies and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of Nanobodies is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of Nanobodies or Nanobody-containing protein therapeutics include strains of *E. coli, Pichia pastoris, S. cerevisiae* that are suitable for large scale expression/production/fermentation, and in particular for large scale pharmaceutical expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a Nanobody-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, Nanobody or polypeptide to be obtained.

Thus, according to one non-limiting embodiment of the invention, the amino acid sequence, Nanobody or polypeptide of the invention is glycosylated. According to another non-limiting embodiment of the invention, the amino acid sequence, Nanobody or polypeptide of the invention is non-glycosylated.

According to one preferred, but non-limiting embodiment of the invention, the amino acid sequence, Nanobody or polypeptide of the invention is produced in a bacterial cell, in particular a bacterial cell suitable for large scale pharmaceutical production, such as cells of the strains mentioned above.

According to another preferred, but non-limiting embodiment of the invention, the amino acid sequence, Nanobody or polypeptide of the invention is produced in a yeast cell, in particular a yeast cell suitable for large scale pharmaceutical production, such as cells of the species mentioned above.

According to yet another preferred, but non-limiting embodiment of the invention, the amino acid sequence, Nanobody or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

When expression in a host cell is used to produce the amino acid sequences, Nanobodies and the polypeptides of the invention, the amino acid sequences Nanobodies and polypeptides of the invention can be produced either intracellullarly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. When eukaryotic host cells are used, extracellular production is usually preferred since this considerably facilitates the further isolation and downstream processing of the Nanobodies and proteins obtained. Bacterial cells such as the strains of E. coli mentioned above normally do not secrete proteins extracellularly, except for a few classes of proteins such as toxins and hemolysin, and secretory production in E. coli refers to the translocation of proteins across the inner membrane to the periplasmic space. Periplasmic production provides several advantages over cytosolic production. For example, the N-terminal amino acid sequence of the secreted product can be identical to the natural gene product after cleavage of the secretion signal sequence by a specific signal peptidase. Also, there appears to be much less protease activity in the periplasm than in the cytoplasm. In addition, protein purification is simpler due to fewer contaminating proteins in the periplasm. Another advantage is that correct disulfide bonds may form because the periplasm provides a more oxidative environment than the cytoplasm. Proteins overexpressed in E. coli are often found in insoluble aggregates, so-called inclusion bodies. These inclusion bodies may be located in the cytosol or in the periplasm; the recovery of biologically active proteins from these inclusion bodies requires a denaturation/refolding process. Many recombinant proteins, including therapeutic proteins, are recovered from inclusion bodies. Alternatively, as will be clear to the skilled person, recombinant strains of bacteria that have been genetically modified so as to secrete a desired protein, and in particular a amino acid sequence, Nanobody or a polypeptide of the invention, can be used.

Thus, according to one non-limiting embodiment of the invention, the amino acid sequence, Nanobody or polypeptide of the invention is an amino acid sequence, Nanobody or polypeptide that has been produced intracellularly and that has been isolated from the host cell, and in particular from a bacterial cell or from an inclusion body in a bacterial cell. According to another non-limiting embodiment of the invention, the amino acid sequence, Nanobody or polypeptide of the invention is an amino acid sequence, Nanobody or polypeptide that has been produced extracellularly, and that has been isolated from the medium in which the host cell is cultivated.

Some preferred, but non-limiting promoters for use with these host cells include,

- for expression in E. coli: lac promoter (and derivatives thereof such as the lacUV5 promoter); arabinose promoter; left-(PL) and rightward (PR) promoter of phage lambda; promoter of the trp operon; hybrid lac/trp promoters (tac and trc); T7-promoter (more specifically that of T7-phage gene 10) and other T-phage promoters; promoter of the Tn10 tetracycline resistance gene; engineered variants of the above promoters that include one or more copies of an extraneous regulatory operator sequence;
- for expression in S. cerevisiae: constitutive: ADH1 (alcohol dehydrogenase 1), ENO (enolase), CYC1 (cytochrome c iso-1), GAPDH (glyceraldehydes-3-phosphate dehydrogenase), PGK1 (phosphoglycerate kinase), PYK1 (pyruvate kinase); regulated: GAL1,10,7 (galactose metabolic enzymes), ADH2 (alcohol dehydrogenase 2), PHO5 (acid phosphatase), CUP1 (copper metallothionein); heterologous: CaMV (cauliflower mosaic virus $^{35}$S promoter);
- for expression in Pichia pastoris: the AOX1 promoter (alcohol oxidase I);
- for expression in mammalian cells: human cytomegalovirus (hCMV) immediate early enhancer/promoter; human cytomegalovirus (hCMV) immediate early promoter variant that contains two tetracycline operator sequences such that the promoter can be regulated by the Tet repressor; Herpes Simplex Virus thymidine kinase (TK) promoter; Rous Sarcoma Virus long terminal repeat (RSV LTR) enhancer/promoter; elongation factor 1α (hEF-1α) promoter from human, chimpanzee, mouse or rat; the SV40 early promoter; HIV-1 long terminal repeat promoter, β-actin promoter;

Some preferred, but non-limiting vectors for use with these host cells include:

- vectors for expression in mammalian cells: pMAMneo (Clontech), pcDNA3 (Invitrogen), pMC1neo (Stratagene), pSG5 (Stratagene), EBO-pSV2-neo (ATCC 37593), pBPV-1 (8-2) (ATCC 37110), pdBPV-MMTneo (342-12) (ATCC 37224), pRSVgpt (ATCC37199), pRSVneo (ATCC37198), pSV2-dhfr (ATCC 37146), pUC-Tag (ATCC 37460) and 1ZD35 (ATCC 37565), as well as viral-based expression systems, such as those based on adenovirus;
- vectors for expression in bacterial cells: pET vectors (Novagen) and pQE vectors (Qiagen);
- vectors for expression in yeast or other fungal cells: pYES2 (Invitrogen) and Pichia expression vectors (Invitrogen);
- vectors for expression in insect cells: pBlueBacII (Invitrogen) and other baculovirus vectors
- vectors for expression in plants or plant cells: for example vectors based on cauliflower mosaic virus or tobacco mosaic virus, suitable strains of Agrobacterium, or Ti-plasmid based vectors.

Some preferred, but non-limiting secretory sequences for use with these host cells include:

- for use in bacterial cells such as E. coli: PelB, Bla, OmpA, OmpC, OmpF, OmpT, StII, PhoA, PhoE, MalE, Lpp, LamB, and the like; TAT signal peptide, hemolysin C-terminal secretion signal;
- for use in yeast: α-mating factor prepro-sequence, phosphatase (pho1), invertase (Suc), etc.;
- for use in mammalian cells: indigenous signal in case the target protein is of eukaryotic origin; murine Ig κ-chain V-J2-C signal peptide; etc.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, Nanobody or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, Nanobody or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, Nanobody or polypeptide of the invention may (first) be generated in an immature form (as mentioned above), which may then be subjected to post-translational modification, depending on the host cell/host organism used. Also, the amino acid sequence, Nanobody or polypeptide of the invention may be glycosylated, again depending on the host cell/host organism used.

The amino acid sequence, Nanobody or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, Nanobody or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one Nanobody of the invention or at least one polypeptide of the invention and at least one suitable carrier, diluent or excipient (i.e. suitable for pharmaceutical use), and optionally one or more further active substances.

Generally, the amino acid sequences, Nanobodies and polypeptides of the invention can be formulated and administered in any suitable manner known per se, for which reference is for example made to the general background art cited above (and in particular to WO 04/041862, WO 04/041863, WO 04/041865 and WO 04/041867) as well as to the standard handbooks, such as Remington's Pharmaceutical Sciences, 18$^{th}$ Ed., Mack Publishing Company, USA (1990) or Remington, the Science and Practice of Pharmacy, 21th Edition, Lippincott Williams and Wilkins (2005).

For example, the amino acid sequences, Nanobodies and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, sterile water and aqueous buffers and solutions such as physiological phosphate-buffered saline, Ringer's solutions, dextrose solution, and Hank's solution; water oils; glycerol; ethanol; glycols such as propylene glycol or as well as mineral oils, animal oils and vegetable oils, for example peanut oil, soybean oil, as well as suitable mixtures thereof. Usually, aqueous solutions or suspensions will be preferred.

The amino acid sequences, Nanobodies and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, Nanobody or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, Nanobodies and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, Nanobodies and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody or polypeptide of the invention. Their percentage in the compositions and preparations may, of course, be varied and may conveniently be between about 2 to about 60% of the weight of a given unit dosage form. The amount of the amino acid sequence, Nanobody or polypeptide of the invention in such therapeutically useful compositions is such that an effective dosage level will be obtained.

The tablets, troches, pills, capsules, and the like may also contain the following: binders such as gum tragacanth, acacia, corn starch or gelatin; excipients such as dicalcium phosphate; a disintegrating agent such as corn starch, potato starch, alginic acid and the like; a lubricant such as magnesium stearate; and a sweetening agent such as sucrose, fructose, lactose or aspartame or a flavoring agent such as peppermint, oil of wintergreen, or cherry flavoring may be added. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, Nanobodies and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, Nanobodies and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, Nanobodies and polypeptides of the invention may also be administered intravenously or intraperitoneally by infusion or injection. Solutions of the amino acid sequences, Nanobodies and polypeptides of the invention or their salts can be prepared in water, optionally mixed with a nontoxic surfactant. Dispersions can also be prepared in glycerol, liquid polyethylene glycols, triacetin, and mixtures thereof and in oils. Under ordinary conditions of storage and use, these preparations contain a preservative to prevent the growth of microorganisms.

The pharmaceutical dosage forms suitable for injection or infusion can include sterile aqueous solutions or dispersions or sterile powders comprising the active ingredient which are adapted for the extemporaneous preparation of sterile injectable or infusible solutions or dispersions, optionally encapsulated in liposomes. In all cases, the ultimate dosage form must be sterile, fluid and stable under the conditions of manufacture and storage. The liquid carrier or vehicle can be a solvent or liquid dispersion medium comprising, for example, water, ethanol, a polyol (for example, glycerol, propylene glycol, liquid polyethylene glycols, and the like), vegetable oils, nontoxic glyceryl esters, and suitable mixtures thereof. The proper fluidity can be maintained, for example, by the formation of liposomes, by the maintenance of the required particle size in the case of dispersions or by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars, buffers or sodium chloride. Prolonged absorption of the injectable compositions can be brought about by the use in the compositions of agents delaying absorption, for example, aluminum monostearate and gelatin.

Sterile injectable solutions are prepared by incorporating the amino acid sequences, Nanobodies and polypeptides of the invention in the required amount in the appropriate solvent with various of the other ingredients enumerated above, as required, followed by filter sterilization. In the case of sterile powders for the preparation of sterile injectable solutions, the preferred methods of preparation are vacuum drying and the freeze drying techniques, which yield a powder of the active ingredient plus any additional desired ingredient present in the previously sterile-filtered solutions.

For topical administration, the amino acid sequences, Nanobodies and polypeptides of the invention may be applied in pure form, i.e., when they are liquids. However, it will generally be desirable to administer them to the skin as compositions or formulations, in combination with a dermatologically acceptable carrier, which may be a solid or a liquid.

Useful solid carriers include finely divided solids such as talc, clay, microcrystalline cellulose, silica, alumina and the like. Useful liquid carriers include water, hydroxyalkyls or glycols or water-alcohoUglycol blends, in which the amino acid sequences, Nanobodies and polypeptides of the invention can be dissolved or dispersed at effective levels, optionally with the aid of non-toxic surfactants. Adjuvants such as fragrances and additional antimicrobial agents can be added to optimize the properties for a given use. The resultant liquid compositions can be applied from absorbent pads, used to impregnate bandages and other dressings, or sprayed onto the affected area using pump-type or aerosol sprayers.

Thickeners such as synthetic polymers, fatty acids, fatty acid salts and esters, fatty alcohols, modified celluloses or modified mineral materials can also be employed with liquid carriers to form spreadable pastes, gels, ointments, soaps, and the like, for application directly to the skin of the user.

Examples of useful dermatological compositions which can be used to deliver the amino acid sequences, Nanobodies and polypeptides of the invention to the skin are known to the art; for example, see Jacquet et al. (U.S. Pat. No. 4,608,392), Geria (U.S. Pat. No. 4,992,478), Smith et al. (U.S. Pat. No. 4,559,157) and Wortzman (U.S. Pat. No. 4,820,508).

Useful dosages of the amino acid sequences, Nanobodies and polypeptides of the invention can be determined by comparing their in vitro activity, and in vivo activity in animal models. Methods for the extrapolation of effective dosages in mice, and other animals, to humans are known to the art; for example, see U.S. Pat. No. 4,938,949.

Generally, the concentration of the amino acid sequence, Nanobodies and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, Nanobodies and polypeptides of the invention required for use in treatment will vary not only with the particular amino acid sequence, Nanobody or polypeptide selected but also with the route of administration, the nature of the condition being treated and the age and condition of the patient and will be ultimately at the discretion of the attendant physician or clinician. Also the dosage of the amino acid sequences, Nanobodies and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

In another aspect, the invention relates to a method for the prevention and/or treatment of at least one IL-6R related disorders, said method comprising administering, to a subject in need thereof, a pharmaceutically active amount of an amino acid sequence of the invention, of a polypeptide of the invention, and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with IL-6R, with its biological or pharmacological activity, and/or with the biological pathways or signalling in which IL-6R is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, the invention relates to a method for the prevention and/or treatment of at least one disease or disorder that can be treated by modulating IL-6R, its biological or pharmacological activity, and/or the biological pathways or signalling in which IL-6R is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, said pharmaceutically effective amount may be an amount that is sufficient to modulate IL-6R, its biological or pharmacological activity, and/or the biological pathways or signalling in which IL-6R is involved The invention also relates to a method for the prevention and/or treatment of at least one disease or disorder that can be prevented and/or treated by administering of an amino acid sequence of the invention or polypeptide of the invention to a patient, said method comprising administering, to a subject in need thereof, a pharmaceutically active amount of an amino acid sequence of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of an amino acid sequence of the invention, of a polypeptide of the invention, and/or of a pharmaceutical composition comprising the same.

In another embodiment, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of an amino acid sequence of the invention, of a polypeptide of the invention, and/or of a pharmaceutical composition comprising the same.

In the above methods, the amino acid sequences, Nanobodies and/or polypeptides of the invention and/or the compositions comprising the same can be administered in any suitable manner, depending on the specific pharmaceutical formulation or composition to be used. Thus, the amino acid sequences, Nanobodies and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, Nanobodies and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequences, Nanobody or polypeptide of the invention to be used, the specific route of administration and farmaceutical formulation or composition to be used, the age, gender, weight, diet, general condition of the patient, and similar factors well known to the clinician.

Generally, the treatment regimen will comprise the administration of one or more amino acid sequences, Nanobodies and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, Nanobody and polypeptide of the invention to be used, the specific route of administration and the specific pharmaceutical formulation or composition used, the amino acid sequences, Nanobodies and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, Nanobody or polypeptide of the invention will be used. It is however within the scope of the invention to use two or more amino acid sequences, Nanobodies and/or polypeptides of the invention in combination.

The amino acid sequences, Nanobodies and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, Nanobodies and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, Nanobody or polypeptide of the invention in the preparation of a pharmaceutical composition for prevention and/or treatment of at least one IL-6R related disorders.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, Nanobody or polypeptide of the invention in the preparation of a pharmaceutical composition for the prevention and/or treatment of at least one disease or disorder that can be prevented and/or treated by administering an amino acid sequence, Nanobody or polypeptide of the invention to a patient.

More in particular, the invention relates to the use of an amino acid sequence, Nanobody or polypeptide of the invention in the preparation of a pharmaceutical composition for the prevention and/or treatment of IL-6R related disorders, and in particular for the prevention and treatment of one or more of the diseases and disorders listed herein.

Again, in such a pharmaceutical composition, the one or more amino acid sequences, Nanobodies or polypeptides of the invention may also be suitably combined with one or more other active principles, such as those mentioned herein.

Finally, although the use of the Nanobodies of the invention (as defined herein) and of the polypeptides of the invention is much preferred, it will be clear that on the basis of the description herein, the skilled person will also be able to design and/or generate, in an analogous manner, other (single) domain antibodies against the IL-6 receptor, as well as polypeptides comprising such (single) domain antibodies (in which the terms "domain antibody" and "single domain antibody" have their usual meaning in the art.

Thus, one further aspect of the invention relates to domain antibodies or single domain antibodies against the IL-6 receptor, and to polypeptides that comprise at least one such (single) domain antibody and/or that essentially consist of such a (single) domain antibody.

In particular, such a (single) domain antibody against the IL-6 receptor may comprise 3 CDR's, in which said CDR's are as defined above for the Nanobodies of the invention. For example, such (single) domain antibodies may be the single domain antibodies known as "dAb's", which are for example as described by Ward et al, supra, but which have CDR's that are as defined above for the Nanobodies of the invention. However, as mentioned above, the use of such "dAb's" will usually have several disadvantages compared to the use of the corresponding Nanobodies of the invention. Thus, any (single) domain antibodies against the IL-6 receptor according to this aspect of the invention will preferably have framework regions that provide these (single) domain antibodies against the IL-6 receptor with properties that make them substantially equivalent to the Nanobodies of the invention.

Thus, in its broadest sense, the invention relates to an amino acid sequence that essentially consists of four framework regions (FR1 to FR4, respectively) and three complementarity determining regions (CDR1 to CDR3, respectively), and that is directed against (as defined herein) the IL-6 receptor. Such an amino acid sequence preferably contains between 80 and 200 amino acid residues, such as between 90 and 150 amino acid residues, such as about 100-130 amino acid residues (although suitable fragments of such an amino acid sequence—i.e. essentially as described herein for the Nanobodies of the invention or equivalent thereto—may also be used), and is preferably such that it forms an immunoglobulin fold or such that, under suitable conditions, it is capable of forming an immunoglobulin fold (i.e. by suitable folding). The amino acid sequence is preferably chosen from Nanobodies, domain antibodies, single domain antibodies or "dAb's", and is most preferably a Nanobody as defined herein. The CDR's may be any suitable CDR's (for which reference is made to the disclosure herein), but are preferably as defined herein.

In further aspects, the invention also relates to proteins and polypeptides that comprise at least one such amino acid sequence; to nucleic acids encoding such amino acid sequences, proteins and polypeptides; to methods for preparing such amino acid sequences, proteins and polypeptides; to host cells expressing or capable of expressing such amino acid sequences, proteins or polypeptides; to compositions, and in particular to pharmaceutical compositions, that comprise such amino acid sequences, proteins, polypeptides, nucleic acids and/or host cells; and to uses of such amino acid sequences, proteins, polypeptides, nucleic acids, host cells and/or compositions, in particular for prophylactic, therapeutic or diagnostic purposes, such as the prophylactic, therapeutic or diagnostic purposes mentioned herein. All these aspects will be clear to the skilled person based on the disclosure herein, and may be essentially the same or equivalent to the embodiments described herein for the Nanobodies of the invention.

Such an amino acid sequence preferably contains between 80 and 200 amino acid residues, such as between 90 and 150 amino acid residues, such as about 100-130 amino acid residues, although suitable fragments of such an amino acid sequence (i.e. essentially as described herein for the Nanobodies of the invention or equivalent thereto) may also be used.

Furthermore, it will also be clear to the skilled person that it may be possible to "graft" one or more of the CDR's mentioned above for the Nanobodies of the invention onto other "scaffolds", including but not limited to human scaffolds or non-immunoglobulin scaffolds. Suitable scaffolds and techniques for such CDR grafting will be clear to the skilled person and are well known in the art, see for example U.S. Pat. No. 7,180,370, WO 01/27160, EP 0 605 522, EP 0 460 167, U.S. Pat. No. 7,054,297, Nicaise et al., Protein Science (2004), 13:1882-1891; Ewert et al., Methods, 2004 October; 34(2):184-199; Kettleborough et al., Protein Eng. 1991 October; 4(7): 773-783; O'Brien and Jones, Methods Mol. Biol. 2003:207:81-100; and Skerra, J. Mol. Recognit. 2000:13:167-187, and Saerens et al., J. Mol. Biol. 2005 Sep. 23; 352(3):597-607, and the further references cited therein. For example, techniques known per se for grafting mouse or rat CDR's onto human frameworks and scaffolds can be used in an analogous manner to provide chimeric proteins comprising one or more of the CDR's of the Nanobodies of the invention and one or more human framework regions or sequences.

Thus, in another embodiment, the invention comprises a chimeric polypeptide comprising at least one CDR sequence chosen from the group consisting of CDR1 sequences, CDR2 sequences and CDR3 sequences mentioned herein for the Nanobodies of the invention. Preferably, such a chimeric polypeptide comprises at least one CDR sequence chosen from the group consisting of the CDR3 sequences mentioned herein for the Nanobodies of the invention, and optionally also at least one CDR sequence chosen from the group consisting of the CDR1 sequences and CDR2 sequences mentioned herein for the Nanobodies of the invention. For example, such a chimeric polypeptide may comprise one CDR sequence chosen from the group consisting of the CDR3 sequences mentioned herein for the Nanobodies of the invention, one CDR sequence chosen from the group consisting of the CDR1 sequences mentioned herein for the Nanobodies of the invention and one CDR sequence chosen from the group consisting of the CDR1 sequences and CDR2 sequences mentioned herein for the Nanobodies of the invention. The combinations of CDR's that are mentioned herein as being preferred for the Nanobodies of the invention will usually also be preferred for these chimeric polypeptides.

In said chimeric polypeptides, the CDR's may be linked to further amino acid sequences and/or may be linked to each other via amino acid sequences, in which said amino acid sequences are preferably framework sequences or are amino acid sequences that act as framework sequences, or together form a scaffold for presenting the CDR's. Reference is again made to the prior art mentioned in the last paragraph. According to one preferred embodiment, the amino acid sequences are human framework sequences, for example $V_H3$ framework sequences. However, non-human, synthetic, semi-synthetic or non-immunoglobulin framework sequences may also be used. Preferably, the framework sequences used are such that (1) the chimeric polypeptide is capable of binding the IL-6 receptor, i.e. with an affinity that is at least 1%, preferably at least 5%, more preferably at least 10%, such as at least 25% and up to 50% or 90% or more of the affinity of the corresponding Nanobody of the invention; (2) the chimeric polypeptide is suitable for pharmaceutical use; and (3) the chimeric polypeptide is preferably essentially non-immunogenic under the intended conditions for pharmaceutical use (i.e. indication, mode of administration, dosis and treatment regimen) thereof (which may be essentially analogous to the conditions described herein for the use of the Nanobodies of the invention).

According to one non-limiting embodiment, the chimeric polypeptide comprises at least two CDR sequences (as mentioned above) linked via at least one framework sequence, in which preferably at least one of the two CDR sequences is a CDR3 sequence, with the other CDR sequence being a CDR1 or CDR2 sequence. According to a preferred, but non-limiting embodiment, the chimeric polypeptide comprises at least two CDR sequences (as mentioned above) linked at least two framework sequences, in which preferably at least one of the three CDR sequences is a CDR3 sequence, with the other two CDR sequences being CDR1 or CDR2 sequences, and preferably being one CDR1 sequence and one CDR2 sequence. According to one specifically preferred, but non-limiting embodiment, the chimeric polypeptides have the structure FR1'-CDR1-FR2'-CDR2-FR3'-CDR3-FR4', in which CDR1, CDR2 and CDR3 are as defined herein for the CDR's of the Nanobodies of the invention, and FR1', FR2', FR3' and FR4' are framework sequences. FR1', FR2', FR3' and FR4' may in particular be Framework 1, Framework 2, Framework 3 and Framework 4 sequences, respectively, of a human antibody (such as $V_H3$ sequences) and/or parts or fragments of such Framework sequences. It is also possible to use parts or fragments of a chimeric polypeptide with the structure FR1'-CDR1-FR2'-CDR2-FR3'-CDR3-FR4. Preferably, such parts or fragments are such that they meet the criteria set out in the preceding paragraph.

The invention also relates to proteins and polypeptides comprising and/or essentially consisting of such chimeric polypeptides, to nucleic acids encoding such proteins or polypeptides; to methods for preparing such proteins and polypeptides; to host cells expressing or capable of expressing such proteins or polypeptides; to compositions, and in particular to pharmaceutical compositions, that comprise such proteins or polypeptides, nucleic acids or host cells; and to uses of such proteins or polypeptides, such nucleic acids, such host cells and/or such compositions, in particular for prophylactic, therapeutic or diagnostic purposes, such as the prophylactic, therapeutic or diagnostic purposes mentioned herein. For example, such proteins, polypeptides, nucleic acids, methods, host cells, compositions and uses may be analogous to the proteins, polypeptides, nucleic acids, methods, host cells, compositions and use described herein for the Nanobodies of the invention.

It should also be noted that, when the Nanobodies of the inventions contain one or more other CDR sequences than the preferred CDR sequences mentioned above, these CDR sequences can be obtained in any manner known per se, for example from Nanobodies (preferred), $V_H$ domains from conventional antibodies (and in particular from human antibodies), heavy chain antibodies, conventional 4-chain antibodies (such as conventional human 4-chain antibodies) or other immunoglobulin sequences directed against the IL-6 receptor. Such immunoglobulin sequences directed against the IL-6 receptor can be generated in any manner known per se, as will be clear to the skilled person, i.e. by immunization with the IL-6 receptor or by screening a suitable library of immunoglobulin sequences with the IL-6 receptor, or any suitable combination thereof. Optionally, this may be followed by techniques such as random or site-directed mutagenesis and/or other techniques for affinity maturation known per se. Suitable techniques for generating such immunoglobulin sequences will be clear to the skilled person, and for example include the screening techniques reviewed by Hoogenboom, Nature Biotechnology, 23, 9, 1105-1116 (2005). Other techniques for generating immunoglobulins against a specified target include for example the Nanoclone® technology (as for example described in the published US patent application 2006-0211088), so-called SLAM technology (as for example described in the European patent application 0 542 810), the use of transgenic mice expressing human immunoglobulins or the well-known hybridoma techniques (see for example Larrick et al, Biotechnology, Vol. 7, 1989, p. 934). All these techniques can be used to generate immunoglobulins against the IL-6 receptor, and the CDR's of such immunoglobulins can be used in the Nanobodies of the invention, i.e. as outlined above. For example, the sequence of such a CDR can be determined, synthesized and/or isolated, and inserted into the sequence of a Nanobody of the invention (e.g. so as to replace the corresponding native CDR), all using techniques known per se such as those described herein, or Nanobodies of the invention containing such CDR's (or nucleic acids encoding the same) can be synthesized de novo, again using the techniques mentioned herein.

Further uses of the amino acid sequences, Nanobodies, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify IL-6R from compositions and preparations comprising the same. Derivatives of the amino acid sequences of the invention that comprise a suitable detectable label can also be used as markers to determine (qualitatively or quantitatively) the presence of IL-6R in a composition or preparation or as a marker to selectively detect the presence of IL-6R on the surface of a cell or tissue (for example, in combination with suitable cell sorting techniques).

BRIEF DESCRIPTION OF THE DRAWINGS

The invention will now be further described by means of the following non-limiting examples and figures, in which the Figures show:

FIG. 2-2E (FIG. 2: Panel A-D; FIG. 2A: Panel E-G; FIG. 2B: Panel H-K; FIG. 2C: Panel L-O; FIG 2D: Panel P-S; FIG. 2E: Panel T-W) FACS analysis of immune response in llamas 081 and 082.

FIG. 5A-B Protein sequences of anti-IL6R Nanobodies.

FIG. 6 Protein sequences of a selected subset of inhibitory anti-IL6R Nanobodies.

FIG. 7-7A (FIG. 7: Panel A-D; FIG. 7A: Panel E-H) Binding of monovalent inhibitory anti IL6R Nanobodies to IL6-R on U266 cells. Fluorescence intensity is blotted on the X-axis, the number of events on the Y-axis. Purified anti-IL6-R antibody BR-6 was included.

FIGS. 8-8A (FIG. 8: Panel A-C; FIG. 8A: Panel D-F), 9-9A (FIG. 9: Panel A-C; FIG. 9A: Panel D-F) and 10-10A (FIG. 10: Panel A-C.

FIG. 11-11A (FIG 11: Panel A-H; FIG. 11A: Panel I-P) Antagonistic activity of 14 monovalent anti IL6R Nanobodies in cell-based assay (XG-1). BR6, BN12 and the Reference-Fab were included as a reference.

FIG. 12-12A (FIG. 12: Panel A-E; FIG. 12A: Panel F-J): Competitive binding of monovalent anti IL6R Nanobodies to sIL6-R in human plasma FIG. 13-13A (FIG. 13: Panel A-D; FIG. 13A: Panel E-H) Competitive binding of monovalent anti IL6R Nanobodies to sIL6-R in cynomolgus plasma FIG. 14 SDS-PAGE of purified bispecific anti IL6R/anti SA Nanobodies. M=molecular weight markers. The identity of the Nanobodies is shown on top of the gel.

FIG. 15-15A (FIG. 15: Panel A-B; FIG. 15A: Panel C-F) Binding of bispecific anti IL6R/anti SA Nanobodies to IL6-R on U266 cells. Fluorescence intensity is blotted on the X-axis, the number of events on the Y-axis. Purified anti-IL6-R antibody BR-6 was included.

FIGS. 16-16A (FIG. 16: Panel A-C; FIG. 16A: Panel D-F) and 17-17A (FIG. 17: Panel A-C.

FIGS. 18-18A (FIG. 18: Panel A-C; FIG. 18A: Panel D-F), 19-19A (FIG. 19: Panel A-C; FIG. 19A: Panel D-F) and 20 (Panel A-C) Antagonistic activity of bispecific anti IL6R/anti SA Nanobodies in cell-based assay (XG-1). BR6, BN12 and the Reference-Fab were included as a reference.

FIGS. 21-21A (FIG. 21: Panel A-C; FIG. 21A: Panel D-F) and 22 (Panel A-D) Antagonistic activity of bispecific anti IL6R/anti SA Nanobodies in the presence of 1 mg/mL human serum albumin in cell-based assay (XG-1). BR6, BN12 and the Reference-Fab were included as a reference.

FIG. 27 Sequences of different humanized variants of IL6R03, IL6R04 and IL6R13.

FIG. 35 (Panel A-F) Flow cytometric analysis of IMAC-purified Nanobodies from selected clones. IMAC-purified Nanobodies IL6R-24, IL6R-44, IL6R-202 and IL6R-203 were added to cyno IL6R-positive CHO cells. Detection was performed using a PE-labeled rabbit polyclonal anti-Nanobody serum (R23). Nanobodies binding to cells was measured by an increase in fluorescence intensity as compared to cells that were incubated with FACS buffer (PBS+10% FBS) followed by PE-labeled R23 antiserum. Fluorescence intensity is blotted on the X-axis, the number of events on the Y-axis.

FIG. 38-38A (FIG. 38: Panel A-B; FIG. 38A: Panel C-G) Flow cytometric analysis of purified IL6R04-HSA and HSA-IL6R04 fusion proteins and IL6R04. Purified Nanobody constructs were added to U266 cells. Detection was performed using a PE-labeled rabbit polyclonal anti-Nanobody serum (R23). Nanobody-HSA fusion protein and Nanobody binding to cells was measured by an increase in fluorescence intensity as compared to cells that were incubated with FACS buffer (PBS+10% FBS) followed by PE-labeled R23 antiserum. Fluorescence intensity is blotted on the X-axis, the number of events on the Y-axis. Purified anti-IL6R antibodies BR6 and BN12 were included as positive control.

EXAMPLES

Experimental Part

Figure 1:
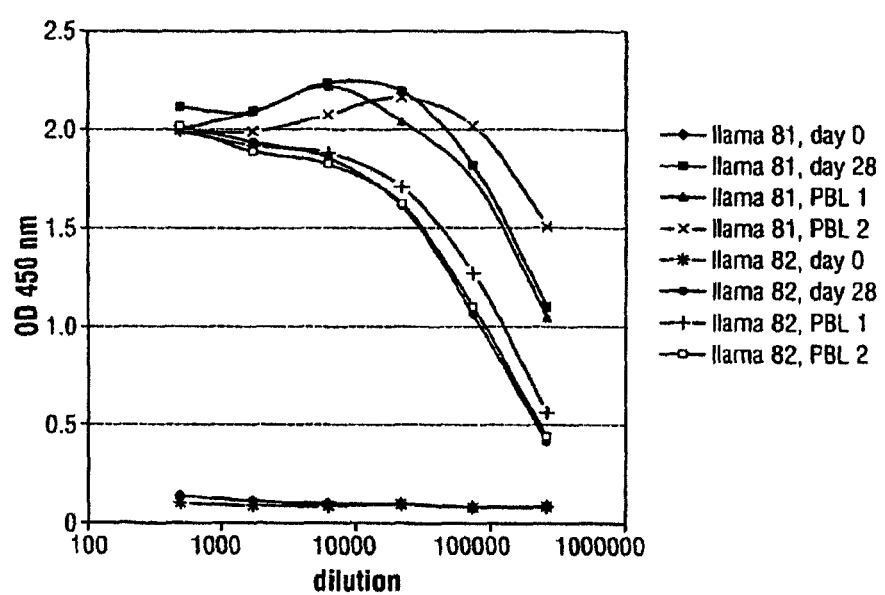
FIG. 1 Analysis of immune response in llamas 81 and 82 by ELISA.

Interleukin-6 (IL6) is a pleiotropic cytokine involved in many physiological processes including regulation of inflammation, immune responses and hematopoiesis. IL6 exerts its biological activities through 2 membrane molecules, a ligand binding 80 kDa chain (IL6-R) and a non-ligand-binding signal transducer gp130. Formation of the IL6-IL6-R-gp130 signaling complex occurs sequentially: first IL6 binds to IL6-R via interaction site I (Kd: ~10 nM). Next step is binding of this complex to gp130 via interaction sites II and III (Kd: 0.8 nM). Interaction sites II and III are composite sites comprising residues of both IL6 and IL6-R. IL6 and IL6-R alone have no detectable affinity for gp130. The exact stoichiometry and composition of the IL6-IL6-R-gp130 complex is still under debate. The crystal structure of IL6-IL6-R-gp130 complex has been solved (Boulanger (2003) Science 300, 2101-2104) and suggests a 2:2:2 stoichiometry. Besides the membrane-bound IL6-R, a soluble form (sIL6-R) can be generated by proteolytic cleavage (TACE/ADAM17) or alternative splicing. The complex of IL6 and sIL6-R can also bind to gp130. Interestingly, this also happens in cells which do not express endogenous IL6-R. Consequently, cells which release the sIL6-R protein render cells which only express gp130 responsive towards the cytokine IL6. This mechanism has been termed trans-signaling.

Overexpression of IL6 has been implicated in the pathogenesis of several clinical disorders including chronic autoimmune diseases, multiple myeloma, Castleman's disease, post-menopausal osteoporosis and renal cell carcinoma. To date, a number of inhibitors of the IL6 signaling pathway have been developed including CNTO-328 (anti-IL6 MAb, Centocor), Tocilizumab (anti-IL6-R MAb, Chugai/Roche) and C326 (anti-IL6 avimer, Avidia). CNTO-328 and Tocilizumab are currently in clinical trials for MM, RCC, RA, soJIA, CD and SLE. Tocilizumab is available on the Japanese market since 2005 for treatment of Castleman's disease (Actemra).

Materials
    Human IL6 was obtained from Diaclone as a recombinant protein produced in E. coli.
    Human bio-IL6 was obtained from Diaclone as human IL6 biotinylated by PE (6 biotins/molecule).
    Human soluble IL6-R was obtained from Peprotech as a recombinant protein produced in HEK293 cells and from R&D Systems as a recombinant protein produced in Sf21 cells.
    MAb BR-6 is a neutralizing anti-IL6-R monoclonal antibody obtained from Diaclone.
    MAb BN-12 is a non-neutralizing anti-IL6-R monoclonal antibody obtained from Diaclone.
    MAb M182 is a biotinylated anti-IL6-R monoclonal antibody obtained from BD Biosciences.
    Llama IgG (h&l) antibody HRP (horse radish peroxidase) conjugated is a polyclonal antibody against llama IgG raised in goat obtained from Bethyl Labs.
    The Reference Fab and Reference IgG were generated as described in the Reference Example below.

Example 1

Immunizations

Two llamas (081 and 082) were immunized with human IL6-R (Peprotech) according to the scheme outlined in Table C-1.

TABLE C-1

Immunization protocol

| Day | Llama 081 | Llama 082 | Tissue collection |
|---|---|---|---|
| 0 | 100 µg | 100 µg | 10 ml pre-immune blood |
| 7 | 100 µg | 100 µg | — |
| 14 | 50 µg | 50 µg | — |
| 21 | 50 µg | 50 µg | — |
| 28 | 50 µg | 50 µg | 10 ml immune blood |
| 35 | 50 µg | 50 µg | — |
| 39 | | | 150 ml immune blood PBL1 lymph node bow biopsy |
| 43 | | | 150 ml immune blood PBL2 |
| 52 | 50 µg | 50 µg | |
| 59 | | | 100 ml immune blood NC1 |

After completion of the protocol the immune response in each animal was analyzed by ELISA. To this end, biotinylated IL6-R (2 µg/ml) was captured in a neutravidin coated microtiter plate. Serial dilutions of serum samples collected at days 0, 28, 39 and 43 were added (starting dilution: 1/500) and bound llama IgG was detected by addition of goat anti-llama IgG HRP labeled. TMB was used as a substrate. Results are shown in FIG. 1.

Immune responses were also analyzed by FACS: serial dilutions (starting dilution: 1/100) of serum samples collected at days 0, 28 and 39 were incubated with U266B1 cells (human myeloma). Bound llama IgG was detected by goat anti-llama IgG FITC labeled. Results are shown in FIG. 2.

Example 2

Library Construction

RNA extracted from peripheral blood lymphocytes and lymph node obtained from llama 081 and 082 was used as starting material for RT-PCR to amplify Nanobody encoding gene fragments. These fragments were cloned into phagemid vector pAX50. Phage was prepared according to standard methods (see for example the prior art and applications filed by Ablynx N.V. cited herein) and stored after filter sterilization at 4° C. for further use. The characteristics of the constructed libraries are shown in Table C-2.

TABLE C-2

Size and percentages of inserts of constructed libraries

| | Library size | % insert |
|---|---|---|
| Llama 81 | $6 \times 10^7$ | 87 |
| Llama 82 | $5 \times 10^7$ | 78 |

Example 3

Selections

Selections were carried out with the above libraries using various conditions as summarized in Table C-3.

TABLE C-3

Experimental conditions used in different selection strategies

| Method | Immobilization/ capture | Antigen | Concentration/ amount | Elution |
|---|---|---|---|---|
| Magnetic beads | Streptavidin | bio-IL6-R | 0, 1, 10, 100 ng | Trypsin |
| Solution | Streptavidin beads | bio-IL6-R | 0, 0.01, 0.1, 1 nM | Trypsin |
| Plate | BN-12 | IL6-R (Peprotech) | 0, 1, 10, 100 nM | Trypsin |
| Plate | BN-12 | IL6-R (R&D) | 0, 1, 10, 100 nM | Trypsin |

Only a single round of selection was performed for all conditions. Each selection output was analyzed for enrichment factor (# phage present in eluate relative to control), diversity (HinfI profiling) and percentage of IL6-R positive clones (ELISA). Based on these parameters the best selections were chosen for further analysis. To this end, the output from each selection was recloned as a pool into the expression vector pAX51. Colonies were picked and grown in 96 deep well plates (1 ml volume) and induced by adding IPTG for Nanobody expression. Periplasmic extracts (volume: ~80 µl) were prepared according to standard methods (see for example the prior art and applications filed by Ablynx N.V. cited herein).

Example 4

Screening

Figure 3:
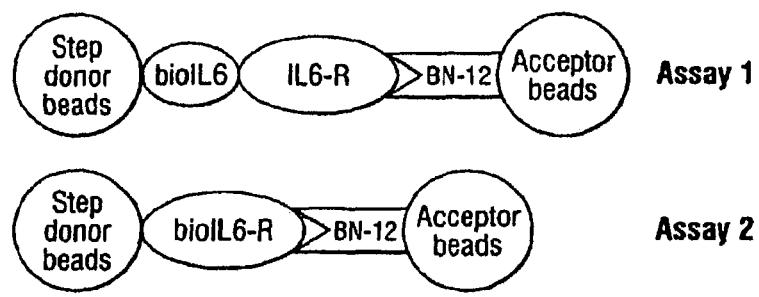
FIG. 3 Schematic representation of Alphascreen assays used to identify Nanobodies against the IL6 binding site on IL6R.

Periplasmic extracts were analyzed first for their ability to inhibit the IL6-IL6-R interaction. To this end, 2 independent Alphascreen assays were set up which are depicted schematically in FIG. 3. In assay 1, the periplasmic extracts were incubated with biotinylated IL6 (3 nM), soluble IL6 receptor (1 nM), streptavidin coated donor beads and MAb BN-12 coated acceptor beads (20 µg/ml). Nanobodies positive in this assay could either inhibit the IL6-IL6-R interaction or IL6-R-MAb BN-12 interaction. To discriminate between these 2 possibilities a second assay was set up (Assay 2). In this assay the periplasmic extract were incubated with bio-IL6-R (0.3 nM), streptavidin coated donor beads and MAb BN-12 coated acceptor beads (10 µg/ml). Nanobodies positive in assay 1 but negative in assay 2 were considered as IL6-IL6-R inhibitors. Periplasmic extracts were diluted 25-fold in both assays which corresponds roughly to a final concentration of 40 nM.

This resulted in two different subclasses of anti-IL6-R Nanobodies; i.e.

a) Nanobodies against IL6-R that were capable of modulating (e.g. partially or fully reducing or preventing) binding of IL6 to IL6-R. In the present example, these were obtained in selections where IL6-R was immobilized on MAb BN-12 (although other methods of obtaining such Nanobodies will be clear to the skilled person).

b) Nanobodies against IL6-R that were capable of modulating (e.g. partially or fully reducing or preventing) binding of IL6-R to MAb BN-12. In the present example, these were obtained in alternative selection strategies where IL6-R was not immobilized on MAb BN-12 (although other methods of obtaining such Nanobodies will be clear to the skilled person).

A statistical overview of the screening effort is shown in Table C-4. Nanobodies showing the strongest inhibition were selected for further characterization.

TABLE C-4

Screening for Nanobodies that inhibit the IL6/IL6-R interaction

| Assay | # clones screened | # inhibitors (%) | # clones sequenced | # unique sequences |
|---|---|---|---|---|
| IL6-IL6-R | 1536 | 72 (4.7%) | 46 | 14 |

Example 5

Nanobody Expression and Purification

Selected Nanobodies were expressed in *E. coli* as c-myc, His6-tagged proteins in a culture volume of 50 mL. Expression was induced by addition of 1 mM IPTG and allowed to continue for 4 h at 37° C. After spinning the cell cultures, periplasmic extracts were prepared by freeze-thawing the pellets. These extracts were used as starting material for immobilized metal affinity chromatography (IMAC). Nanobodies were eluted from the column with 150 mM imidazole and subsequently dialyzed against PBS. Total yield and yield per liter of cell culture are listed in Table C-5.

Figure 4:
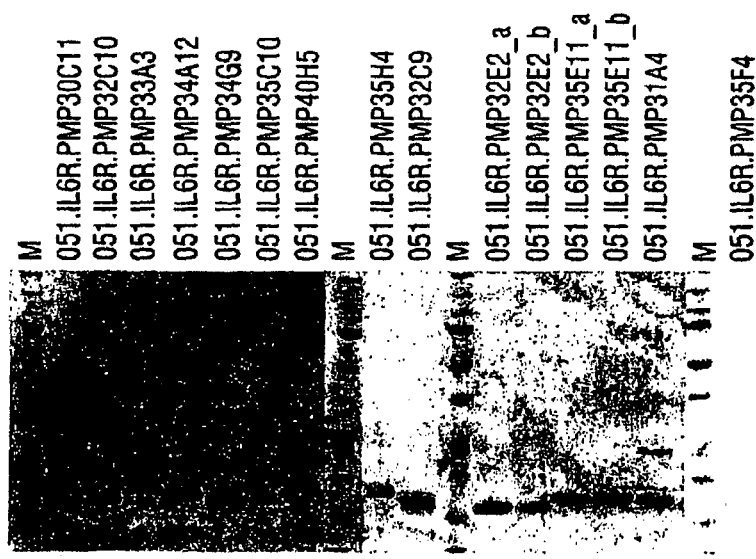
FIG. 4 SDS-PAGE of purified monovalent anti IL6R Nanobodies. M=molecular weight markers. The identity of the Nanobodies is shown on top of the gel.

SDS-PAGE of purified Nanobodies is shown in FIG. 4.

TABLE C-5

Expression yields of anti-IL6-R Nanobodies in *E. coli*

| Nanobody ID | yield (mg) | yield (mg/l) | Nanobody ID | yield (mg) | yield (mg/l) |
|---|---|---|---|---|---|
| PMP40H5 | 0.14 | 0.6 | PMP34G9 | 0.09 | 1.8 |
| PMP35E11 | 0.65 | 2.6 | PMP31A4 | 1.06 | 4.2 |
| PMP32C9 | 0.33 | 6.5 | PMP32E2 | 1.57 | 6.3 |
| PMP35H4 | 0.49 | 9.8 | PMP33A3 | 0.33 | 1.3 |
| PMP32E10 | 0.78 | 3.1 | PMP34A12 | 0.57 | 2.3 |
| PMP30C11 | 0.63 | 2.5 | PMP28E11 | 0.08 | 1.6 |
| PMP35C10 | 0.53 | 2.1 | PMP35F4 | 0.24 | 1.0 |

Example 6

Characterization of Monovalent Nanobodies

For simplicity, monovalent clones were renamed. An overview is given in Table C-6 below.

TABLE C-6

Overview of nomenclature of monovalent anti-IL6R Nanobodies

| ID | Original name |
|---|---|
| IL6R01 | PMP28E11 |
| IL6R02 | PMP30C11 |
| IL6R03 | PMP31A4 |
| IL6R04 | PMP32C9 |
| IL6R05 | PMP32E10 |
| IL6R06 | PMP32E2 |
| IL6R07 | PMP33A3 |
| IL6R08 | PMP34A12 |
| IL6R09 | PMP34G9 |
| IL6R10 | PMP35C10 |
| IL6R11 | PMP35E11 |
| IL6R12 | PMP35F4 |
| IL6R13 | PMP35H4 |
| IL6R14 | PMP40H5 | a) Binding to IL6-R in Biacore

Nanobodies showing the strongest inhibition were selected for off-rate analysis on Biacore and DNA sequencing (FIG. 5 and Table C-7).

A subset of 14 inhibitory Nanobodies and 3 control Nanobodies (which do not inhibit the interaction between IL6 and IL6-R) were selected for further analysis in cell based assays. FIG. 6 shows the protein sequences of this selected subset of Nanobodies.

Affinity constants (Kd) of these 14 individual inhibitory Nanobodies were determined by surface plasmon resonance on a Biacore 3000 instrument. In brief, IL6-R is amine-coupled to a CM5 sensor chip at a density of 800-1000 RU. Remaining reactive groups are inactivated. Nanobody binding is assessed at various concentrations ranging from 0.5 to 50 nM. Each sample is injected for 4 min at a flow rate of 45 μl/min to allow for binding to chip-bound antigen. Next, binding buffer without Nanobody is sent over the chip at the same flow rate to allow for dissociation of bound Nanobody. After 10 min, remaining bound analyte is removed by injecting regeneration solution (Glycine/HCl pH1.5). Binding curves obtained at different concentrations of Nanobody are used to calculate Kd values. In Table C-8, an overview of $k_d/k_{off}$, $k_a$, and $k_d$ values for the selected subset of 14 Nanobodies is shown.

TABLE C-7

Off rates (obtained from Biacore-analysis) of anti-IL6-R Nanobodies

| Clone ID | $k_{off}(s^{-1})$ | clone ID | $k_{off}(s^{-1})$ |
|---|---|---|---|
| PMP 35 A3 | 1.18E−03 | PMP 33 B11 | 1.42E−03 |
| PMP 35 C6 | 9.32E−04 | PMP 33 D1 | 9.34E−04 |
| PMP 35 D10 | 3.26E−04 | PMP 33 H10 | 6.69E−04 |

TABLE C-7-continued

Off rates (obtained from Biacore-analysis) of anti-IL6-R Nanobodies

| Clone ID | $k_{off}(s^{-1})$ | clone ID | $k_{off}(s^{-1})$ |
|---|---|---|---|
| PMP 35 G9 | 1.86E−03 | PMP 33 H7 | 1.49E−03 |
| PMP 40 F12 | 4.39E−04 | PMP 35 C10 | 5.09E−04 |
| PMP 31 C5 | 1.11E−04 | PMP 35 E2 | 7.54E−04 |
| PMP 31 D2 | 2.81E−04 | PMP 35 E11 | 4.17E−04 |
| PMP 32 C9 | 1.50E−04 | PMP 35 G11 | 2.05E−04 |
| PMP 32 F10 | 5.80E−04 | PMP 30 A10 | 2.68E−03 |
| PMP 28 A2 | 1.24E−03 | PMP 33 C10 | 3.08E−03 |
| PMP 28 C7 | 1.31E−03 | PMP 35 H4 | 1.78E−04 |
| PMP 28 D4 | 1.85E−03 | PMP 30 D4 | 3.24E−04 |
| PMP 28 F7 | 1.26E−03 | PMP 30 H1 | 2.83E−04 |
| PMP 28 H6 | 2.47E−03 | PMP 33 A2 | 5.00E−04 |
| PMP 31 B11 | 1.24E−03 | PMP 34 F8 | 1.42E−04 |
| PMP 31 B4 | 1.28E−03 | PMP 35 B4 | 3.03E−04 |
| PMP 31 C8 | 1.25E−03 | PMP 40 C9 | 1/3.6E−04 |
| PMP 31 F4 | 1.23E−03 | PMP 40 H5 | 1.14E−04 |
| PMP 32 E10 | 1.27E−03 | PMP 30 B9 | 1.56E−04 |
| PMP 32 H5 | 1.28E−03 | PMP 30 F1 | 1.01E−03 |
| PMP 32 D12 | 2.70E−03 | PMP 34 B4 | 9.53E−04 |
| PMP 30 A2 | 2.57E−03 | PMP 34 F10 | 1.63E−03 |
| PMP 30 B6 | 8.42E−04 | PMP 40 A2 | 5.69E−04 |
| PMP 30 G11 | 1.64E−03 | PMP 28 G3 | 1.93E−03 |
| PMP 34 A12 | To be determined | PMP 30 C11 | 2.94E−03 |
| PMP 34 C3 | 4.35E−04 | PMP 31 A4 | 1.60E−03 |
| PMP 35 H7 | 1.48E−03 | PMP 34 C11 | 3.67E−03 |
| PMP 33 G3 | 1.19E−03 | PMP 34 E10 | 2.00E−03 |
| PMP 34 A5 | 1.68E−03 | PMP 34 G9 | 1.39E−03 |
| PMP 34 D2 | 3.31E−04 | PMP 35 F4 | 8.96E−04 |
| PMP 34 E9 | 5.03E−04 | PMP 28 B1 | 1.34E−03 |
| PMP 34 G3 | 1.40E−04 | PMP 28 E11 | To be determined |
| PMP 30 B1 | 1.00E−03 | PMP 32 E2 | 8.86E−04 |
| PMP 28 G1 | 3.17E−03 | PMP 33 A3 | 2.42E−04 |
| PMP 30 B3 | 2.96E−04 | PMP 28 B2 | 5.39E−03 |
| PMP 30 B7 | 6.66E−04 | PMP 28 D1 | 1.45E−02 |

TABLE C-8

Overview of $k_d/k_{off}$, $k_a$-, and $K_d$-values for a selected subset of 14 inhibitory anti-IL6-R Nanobodies.

| Nanobody ID | $k_d/k_{off}(s^{-1})$ | $k_a$ (1/Ms) | $K_d$ (nM) |
|---|---|---|---|
| IL6R01 | 1.10E−04 | 2.62E+05 | 0.418 |
| IL6R02 | 2.94E−03<br>4.95E−03 | 8.40E+05 | 5.90 |
| IL6R03 | 1.47E−03<br>1.60E−03 | 4.84E+05 | 3.03 |
| IL6R04 | 9.42E−05<br>1.50E−04 | 3.65E+05 | 0.26 |
| IL6R05 | 1.41E−03<br>1.27E−03 | 1.44E+05 | 9.79 |
| IL6R06 | 8.86E−04<br>7.57E−03 | 1.07E+06 | 7.10 |
| IL6R07 | 2.42E−04 | | |
| IL6R08 | 1.97E−03 | 1.94E+05 | 10.2 |
| IL6R09 | 1.29E−03<br>1.30E−03<br>1.39E−03 | 6.41E+05<br>1.11E+06 | 2.01<br>1.17 |
| IL6R10 | 5.26E−04<br>5.09E−04 | 4.14E+05 | 1.27 |
| IL6R11 | 3.40E−04<br>3.96E−04<br>4.17E−04 | 3.91E+05<br>2.15E+05 | 0.87<br>1.85 |
| IL6R12 | 1.16E−03<br>8.96E−04 | 6.78E+05 | 1.71 |
| IL6R13 | 1.21E−03<br>1.09E−04<br>1.78E−04 | 2.31E+05<br>1.37E+05 | 0.53<br>0.79 |
| IL6R14 | 1.00E−04<br>1.14E−04 | 4.02E+05 | 0.25 |
| Reference Fab | 6.60E−04 | 7.68E+05 | 0.86 | b) Binding to IL6-R on U266 Cells

Figure 7:
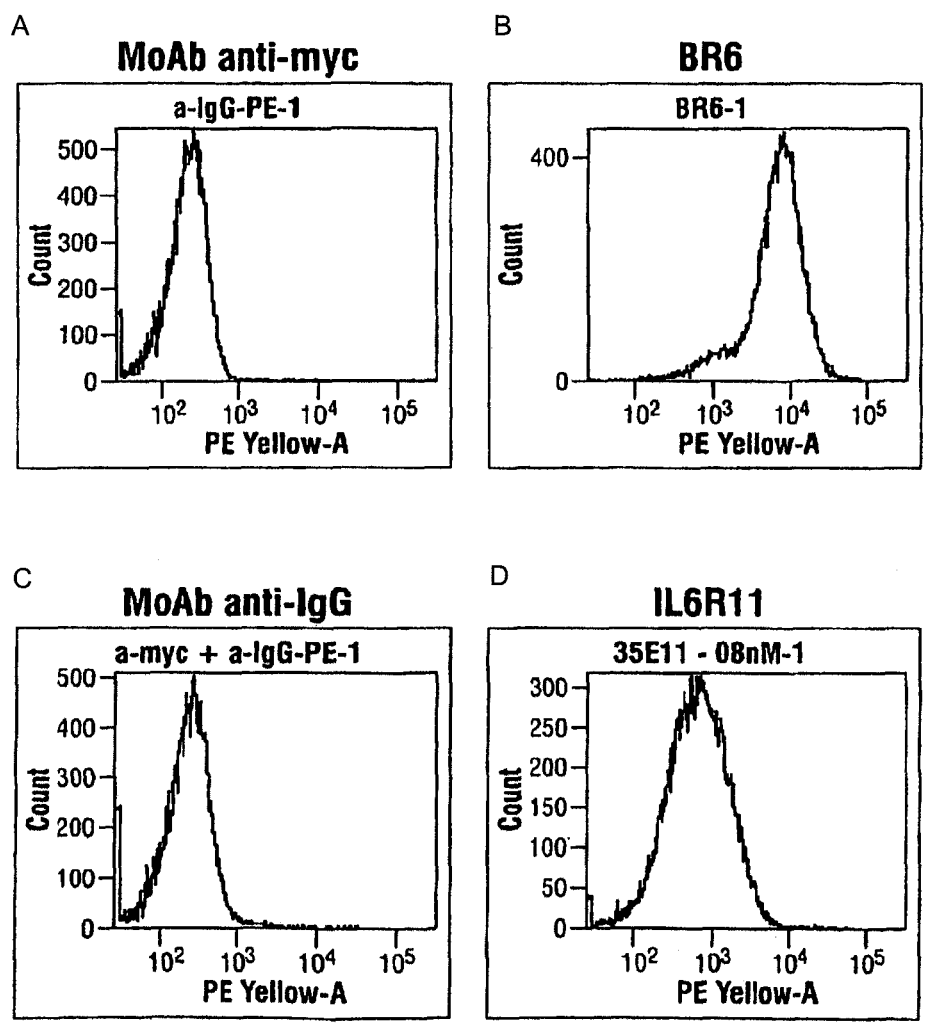

Binding to membrane-bound IL6R expressed on U266 cells was analyzed in FACS. Flow cytometric analysis was performed of IMAC-purified Nanobodies from selected clones (IL6R04, IL6R09, IL6R11, IL6R13, IL6R14). IMAC-purified Nanobodies were added to IL6-R positive U266 cells. Detection was performed by a monoclonal anti-myc antibody followed by a PE-labeled polyclonal anti-mouse antibody (Jackson ImmunoResearch Laboratories 115-115-164 Lot 69854). Nanobodies binding to cells was measured by an increase in fluorescence intensity as compared to cells that were incubated with FACS buffer (PBS+10% FBS) followed by monoclonal anti-myc antibody and/or PE-labeled polyclonal anti-mouse antibody. Results are shown in FIG. 7. Fluorescence intensity is blotted on the X-axis, the number of events on the Y-axis. Purified anti-IL6-R antibody BR-6 was included.

c) Epitope Mapping

Nanobodies were analyzed for competition with Tocilizumab-Fab.

The 14 purified Nanobodies were tested in Alphascreen for inhibition of the Reference-Fab/IL6R interaction. A fixed concentration of purified proteins (100 nM) was added to biotinylated IL6-R (1 nM) and incubated for 15 min. Subsequently Reference-Fab-coated acceptor beads were added and this mixture was incubated for 1 hour. Finally streptavidin donor beads were added and after 1 hour incubator the plate was read on the Envision microplate reader. BR-6, BN12 and the Reference-Fab were included as reference. Results, shown in Table C-9, are expressed as the % binding retained in competition with Reference-Fab. The lower the number, the higher the competition, the higher the overlap in epitope.

TABLE C-9

Inhibition of the Reference-Fab/IL6R interaction by 14 selected inhibitory anti-IL6-R Nanobodies.

| Nanobody ID | % binding retained in competition with Reference-Fab |
|---|---|
| IL6R01 | 49 |
| IL6R02 | 86 |
| IL6R03 | 5 |
| IL6R04 | 50 |
| IL6R05 | 64 |
| IL6R06 | 36 |
| IL6R07 | 80 |
| IL6R08 | 99 |
| IL6R09 | 62 |
| IL6R10 | 102 |
| IL6R11 | 40 |
| IL6R12 | 103 |
| IL6R13 | 25 |
| IL6R14 | 96 | d) Competition Assays/Antagonistic Activity in Alphascreen

Figure 8:
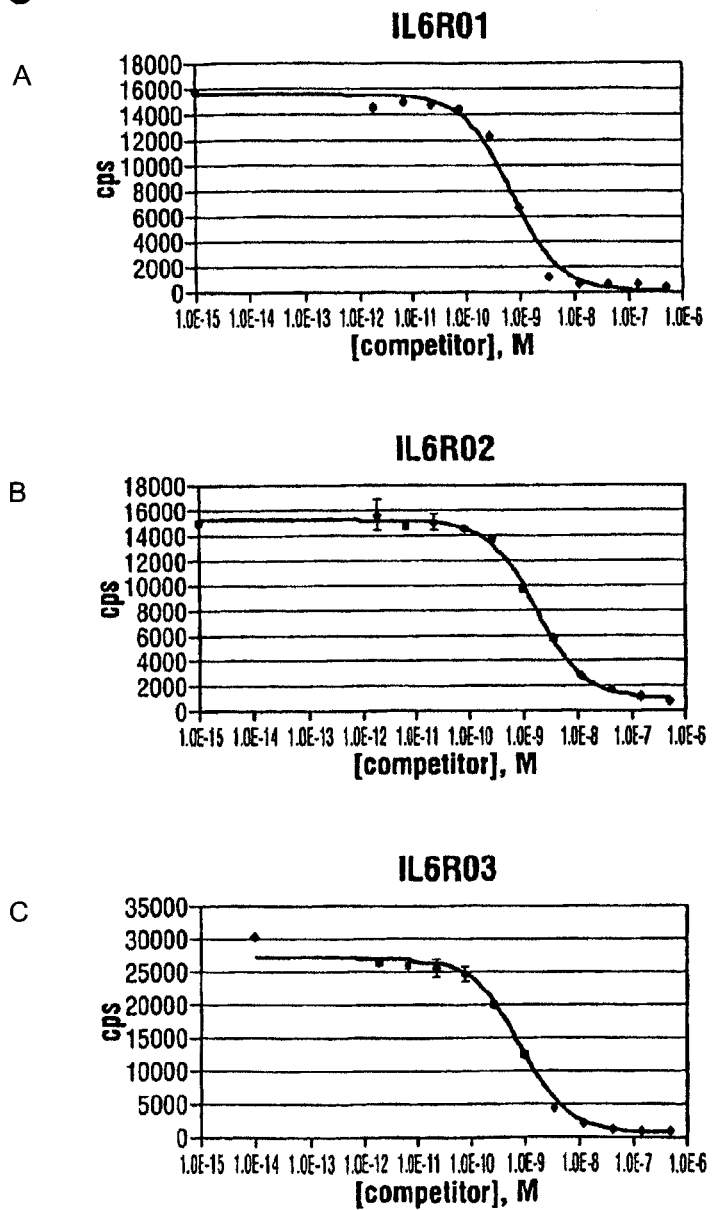
Figure 10:
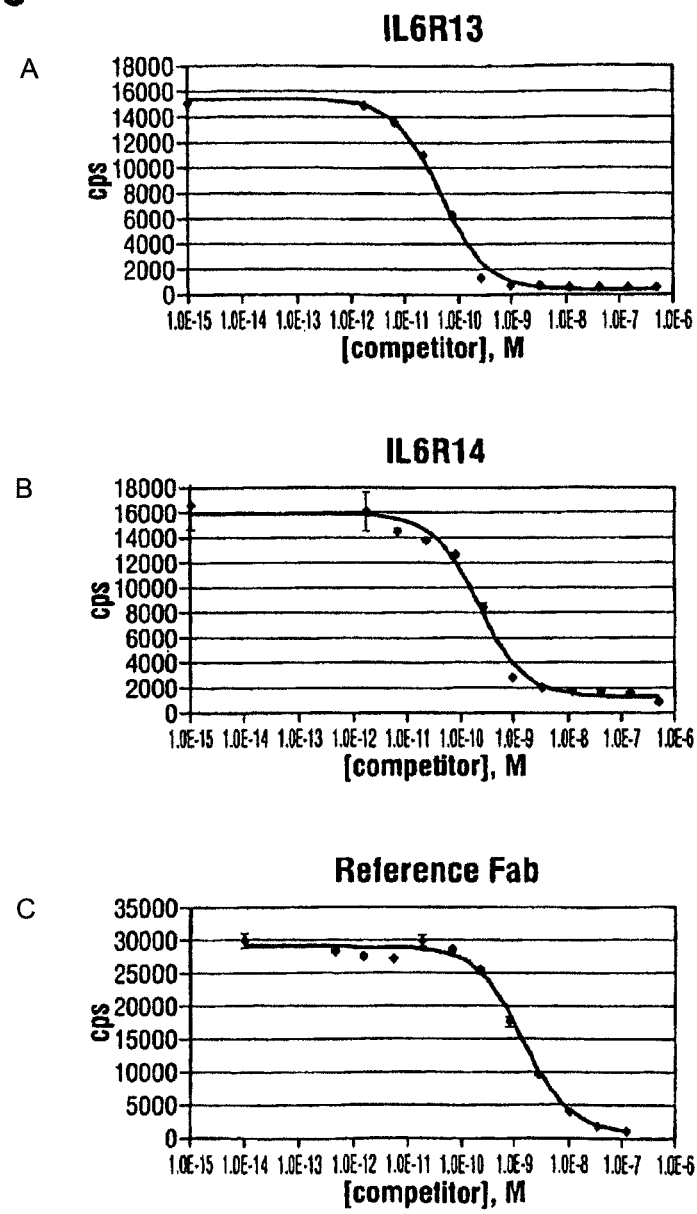
FIG. 10A: Panel D-E) Antagonistic activity of 14 monovalent anti IL6R Nanobodies in alphascreen for inhibition of the IL6/IL6-R interaction.

The 14 purified Nanobodies were tested in Alphascreen for inhibition of the IL6/IL6-R interaction. Serial dilutions of purified proteins (concentration range: 500 nM-10 pM) were added to IL6-R (0.3 nM) and incubated for 15 min. Subsequently 3 nM bio-IL6 and BN12-coated acceptor beads were added and this mixture was incubated for 1 hour. Finally streptavidin donor beads were added and after 1 hour incubator the plate was read on the Envision microplate reader. BR-6 and the Reference-Fab were included as reference. Results are shown in FIGS. 8, 9 and 10. Dose-response curves were observed for all 14 Nanobodies with $IC_{50}$-values ranging from 48 pM to 1.7 nM. As can be seen from FIGS. 8, 9 and 10, the invention provides Nanobodies that, under the conditions of this assay, exhibit essentially full (i.e. >90%; preferably >95%) inhibition of the IL6-IL6-R interaction; or alternatively Nanobodies that, under the conditions of the assay, provide partial inhibition (i.e. between 25% and 90%; preferably between 40% and 75%) of the IL6-IL6-R interaction (e.g. IL6-R07).

e) Antagonistic Activity in Cell-Based Assay (XG-1)

Figure 11:
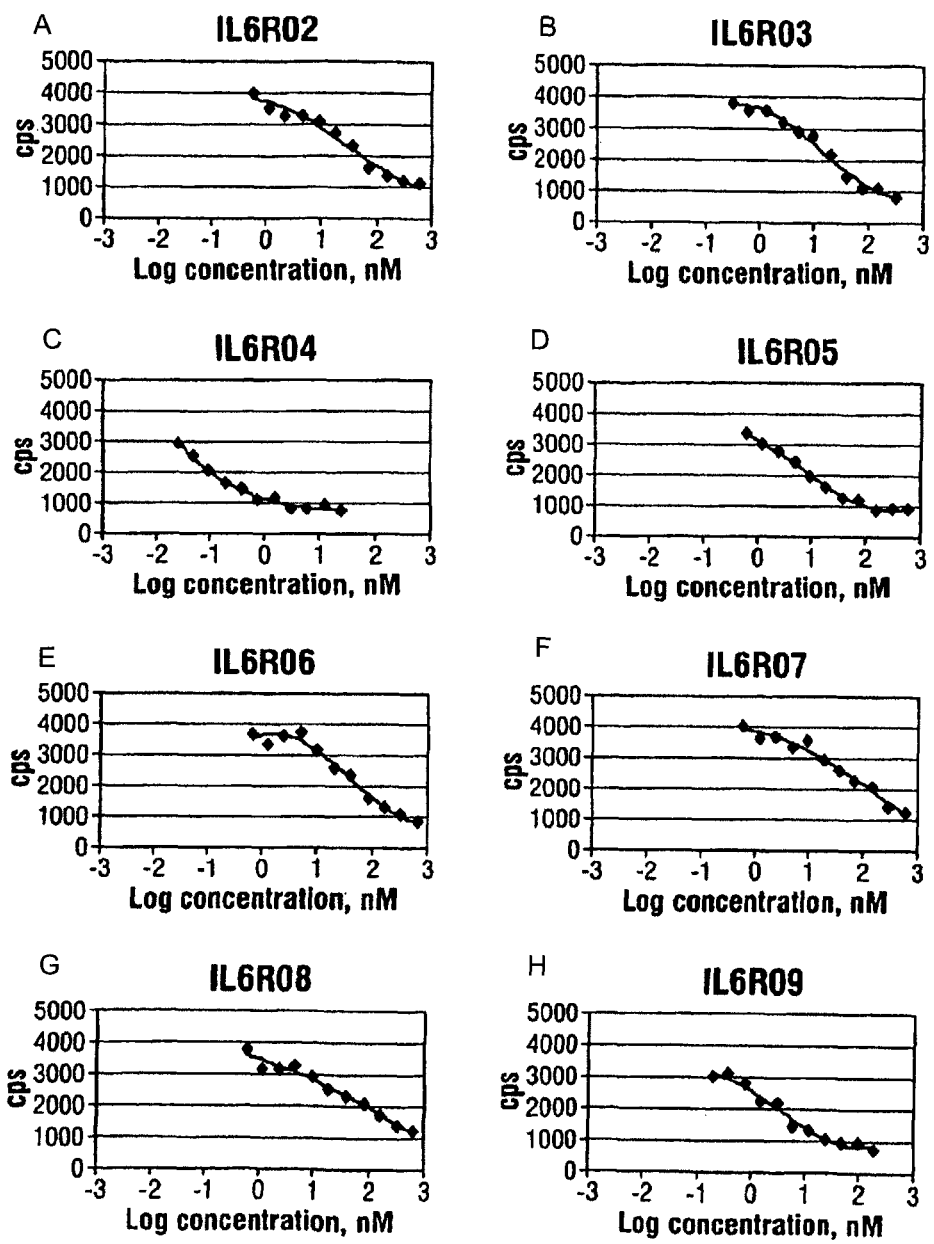

All purified Nanobodies were tested in the XG1 assay. XG1 is an IL6-dependent human myeloma cell line. Half-maximal proliferation is achieved at ~20 pg/ml of IL6. Assays were essentially performed as described by Zhang et al. (Blood 83: 3654-3663). BR6, BN12 and the Reference-Fab were included as a reference. Results are outlined in FIG. 11. IC50 values ranged from 50 nM to 90 pM and are presented in Table C-10.

TABLE C-10

IC50 values of 14 selected inhibitory anti-IL6-R Nanobodies measured in XG-1 cell based assay

| ID | IC50 (nM) |
|---|---|
| IL6R02 | 31.04 |
| IL6R03 | 16.16 |
| IL6R04 | 0.089 |
| IL6R05 | 7.295 |
| IL6R06 | 42.05 |
| IL6R07 | 50.47 |
| IL6R08 | 36.6 |
| IL6R09 | 2.745 |
| IL6R10 | 2.546 |
| IL6R11 | 5.366 |
| IL6R12 | 2.753 |
| IL6R13 | 1.395 |
| IL6R14 | 0.603 |
| Reference-Fab | 5.985 |
| BN12 | 0.2721 |
| BR6 | 0.064 | f) Potency of Monovalent Wild Type Nanobodies in Cell-Based Assay (TF-1)

The TF-1 cell (ECACC) line was maintained between 2-9× 100,000 cells/mL using RPMI 1640 supplemented with 2 mM Glutamine, 1% Sodium pyruvate, 3 ng/mL Human GM-CSF (eBiosciences) and 10% Foetal Bovine serum (Gibco). Cells were subcultured 3 times a week and were maintained at 37% and a 5% $CO_2$ atmosphere. The same batch of GM-CSF (Lot E019991) and of Foetal Bovine Serum (lot no 41Q4556K) was used.

The cell-based assay was performed similarly as described in de Hon, F. D., Ehlers, M., Rose-John, S., Ebeling, S. B., Bos, H. K., Aarden, L. A., and Brakenhoff, J. P. (1994) J Exp Med 180, 2395-2400. Cell suspensions were centrifuged for 5 min at 200 g and the supernatant was removed. Cells were resuspended in RPMI 1640 supplemented with 2 mM Glutamine, 1% Sodium pyruvate and 10% Foetal Bovine serum, were seeded at a density of 12500 cells/well in a 96-well plate and incubated for 72 h with different dilutions of Nanobodies® and a constant amount of 500 pg/mL IL-6. The 96-well plates were incubated in a humid chamber. Every sample was analysed in triplicate. The total volume/well was 200 µL. During the last 6 h of the incubation, cells were pulse-labeled with 0.2 µCi/well of $^3$H-thymidine (GE Healthcare) in a total volume of 20 µL. Cells were harvested with a semiautomatic cell harvester (Filtermate harvester, PerkinElmer) and the $^3$H-thymidine incorporation was measured using a Topcount NXT counter (PerkinElmer). Results are expressed as average counts per minute (cpm) per well. IC 50 values are summarised in Table C-11.

TABLE C-11

IC50 values obtained in TF-1 assay of monovalent wild type Nanobodies IC50 (nM) TF-1

| | |
|---|---|
| IL6R04 | 0.545 |
| IL6R14 | 1.751 |
| IL6R11 | 6.623 |
| IL6R12 | 6.915 |
| IL6R13 | 7.197 |
| IL6R10 | 9.147 |
| IL6R09 | 10.01 |
| IL6R05 | 19.94 |
| IL6R03 | 28.05 |
| IL6R02 | 29.66 |
| IL6R07 | 35 |
| IL6R08 | 42.88 |
| IL6R06 | 77.23 | g) Binding to sIL6-R in Human Plasma

Figure 12:
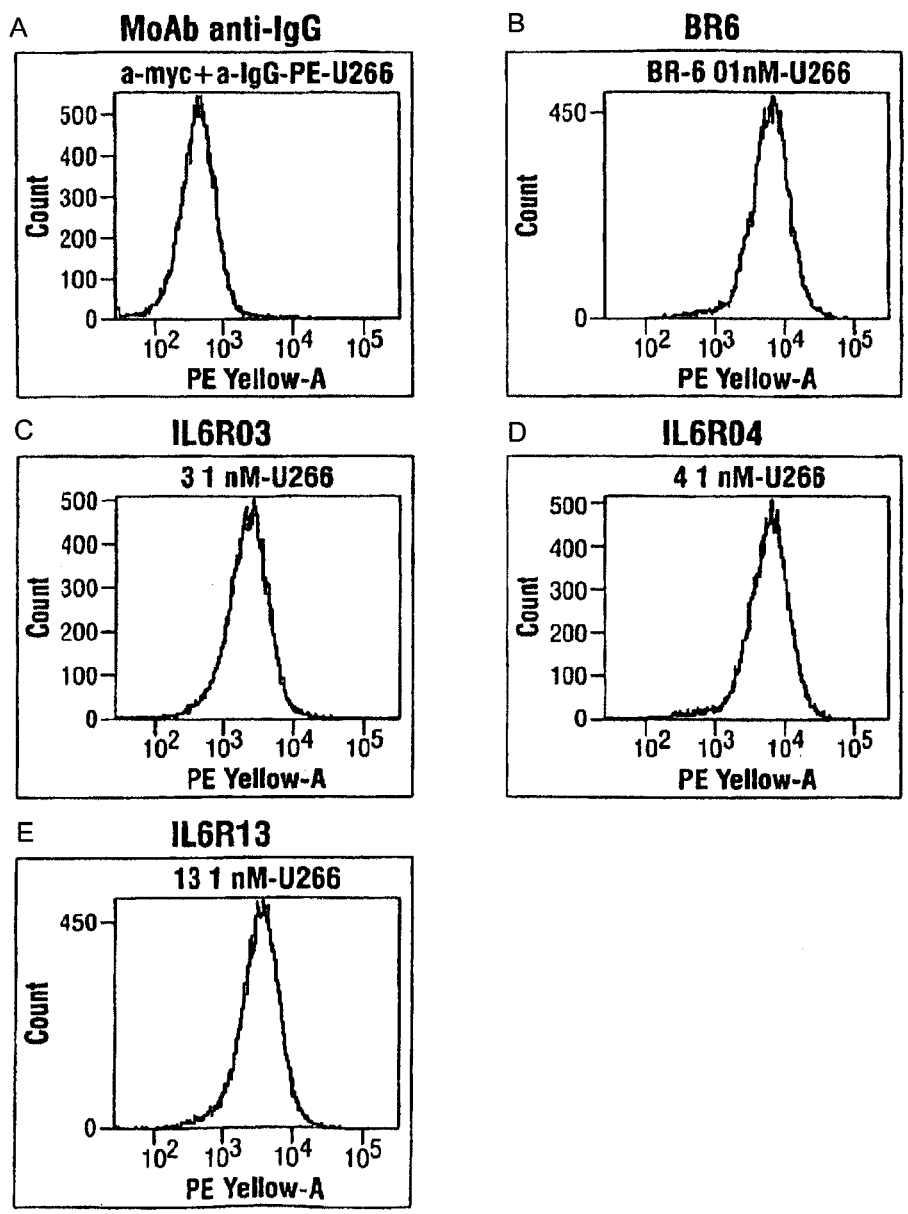

Soluble human IL6-R is present in plasma in the range of 80 ng/ml-400 ng/ml (Jones et al., 2001, FASEB Journal 15:43-58). To analyze whether Nanobodies bind to naturally occurring sIL6R, binding of monovalent nanobodies to U266 cells was performed in presence of human plasma. Competitive binding could be demonstrated indicating that soluble IL6-R is bound by the Nanobodies analyzed. Inhibition of binding of monovalent IMAC-purified Nanobodies from selected clones (IL6R03, IL6R04, IL6R13) to U266 cells in the presence of human plasma was measured. IMAC-purified Nanobodies were added to IL6-R positive U266 cells in the presence of human plasma. Detection was performed by a monoclonal anti-myc antibody followed by a PE-labeled polyclonal anti-mouse antibody. Inhibition of binding of Nanobodies to cells in the presence of human plasma was measured by a decrease in fluorescence intensity as compared to the fluorescence intensity of Nanobodies binding to cells in the absence of human plasma. Results are shown in FIG. 12. Fluorescence intensity is blotted on the X-axis, the number of events on the Y-axis. Purified anti-IL6-R antibody BR-6 was included. U266 cells incubated with monoclonal anti-myc antibody followed by a PE-labeled polyclonal anti-mouse antibody in the presence/absence of human plasma served as background staining control.

h) Binding to sIL6-R in Cynomolgus Plasma

Soluble human IL6-R is present in plasma in the range of 80 ng/ml-400 ng/ml (Jones et al., 2001, FASEB Journal 15:43-58). To analyze whether Nanobodies bind to naturally occurring sIL6R, binding of monovalent nanobodies to U266 cells was performed in presence of cynomolgus plasma. Competitive binding could be demonstrated indicating that soluble IL6-R is bound by the Nanobodies analyzed. Inhibition of binding of monovalent IMAC-purified Nanobodies from selected clones (IL6R04, IL6R13) to U266 cells in the presence of cynomolgus plasma. IMAC-purified Nanobodies were added to IL6-R positive U266 cells in the presence of cynomolgus plasma was measured. Detection was performed by a monoclonal anti-myc antibody followed by a PE-labeled polyclonal anti-mouse antibody. Inhibition of binding of Nanobodies to cells in the presence of cynomolgus plasma was measured by a decrease in fluorescence intensity as compared to the fluorescence intensity of Nanobodies binding to cells in the absence of cynomolgus plasma. Results are shown in FIG. 13. Fluorescence intensity is blotted on the X-axis, the number of events on the Y-axis. Purified anti-IL6-R antibody BR-6 was included. U266 cells incubated with monoclonal anti-myc antibody followed by a PE-labeled polyclonal anti-mouse antibody in the presence/absence of cynomolgus plasma served as background staining control.

i) Cross-Reactivity to Mouse IL6-R

Binding to mouse IL6-R(R&D Systems, cat#1830-SR/CF) was analyzed in ELISA. A maxisorp 96-well plate was coated with mouse IL6-R (1 μg/ml), blocked and incubated with a dilution series of Nanobodies (500 nM-0.16 nM). Bound Nanobodies were detected using anti-Myc and anti-mouse horse radish peroxidase using TMB substrate. No binding could be observed.

Example 7

Construction and Expression of Bi-Specific Anti-IL6-R Nanobodies

Figure 14:
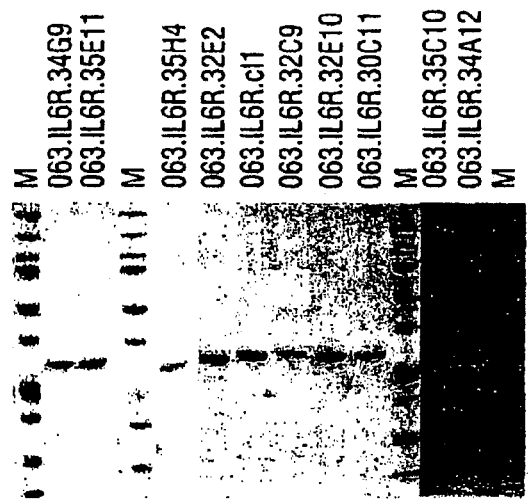

All 14 selected Nanobodies were also expressed as bispecifics consisting of a C-terminal anti-HSA Nanobody (ALB-1), a 9 amino acid Gly/Ser linker and an N-terminal anti-IL6-R Nanobody. These constructs were expressed in E. coli as c-myc, His6-tagged proteins and subsequently purified from the culture medium by immobilized metal affinity chromatography (IMAC) and size exclusion chromatography (SEC). Total yield and yield per liter of cell culture are listed in Table C-12. SDS-PAGE of purified Nanobodies is shown in FIG. 14.

TABLE C-12

Expression yields of bi-specific anti-IL6-R Nanobodies in E. coli

| Nanobody ID | yield (mg) | yield (mg/L) |
|---|---|---|
| PMP28E11-9GS-ALB-1 | tbd | |
| PMP30C11-9GS-ALB-1 | 1.06 | 4.22 |
| PMP31A4-9GS-ALB-1 | tbd | |
| PMP32C9-9GS-ALB-1 | 0.50 | 1.98 |
| PMP32E2-9GS-ALB-1 | 1.05 | 4.19 |
| PMP32E10-9GS-ALB-1 | 1.25 | 5.00 |
| PMP33A3-9GS-ALB-1 | tbd | |
| PMP34A12-9GS-ALB-1 | 2.11 | 8.44 |
| PMP34G9-9GS-ALB-1 | 3.30 | 13.2 |
| PMP35C10-9GS-ALB-1 | 0.93 | 3.74 |
| PMP35E11-9GS-ALB-1 | 1.82 | 7.28 |
| PMP35F4-9GS-ALB-1 | tbd | |
| PMP35H4-9GS-ALB-1 | 1.88 | 7.52 |
| PMP40H5-9GS-ALB-1 | tbd | |

Example 8

Characterization of Bi-Specific Anti-IL6-R Nanobodies

For simplicity, bispecific clones were renamed. An overview is given in Table C-13 below.

TABLE C-13

Overview of nomenclature of bispecific anti-IL6R Nanobodies

| ID | Formatted Nanobody |
|---|---|
| IL6R21 | Bispecific PMP28E11-9AA GlySer-ALB-1 |
| IL6R22 | Bispecific PMP30C11-9AA GlySer-ALB-1 |
| IL6R23 | Bispecific PMP31A4-9AA GlySer-ALB-1 |
| IL6R24 | Bispecific PMP32C9-9AA GlySer-ALB-1 |
| IL6R25 | Bispecific PMP32E10-9AA GlySer-ALB-1 |
| IL6R26 | Bispecific PMP32E2-9AA GlySer-ALB-1 |
| IL6R27 | Bispecific PMP33A3-9AA GlySer-ALB-1 |
| IL6R28 | Bispecific PMP34A12-9AA GlySer-ALB-1 |
| IL6R29 | Bispecific PMP34G9-9AA GlySer-ALB-1 |

TABLE C-13-continued

Overview of nomenclature of bispecific anti-IL6R Nanobodies

| ID | Formatted Nanobody |
|---|---|
| IL6R30 | Bispecific PMP35C10-9AA GlySer-ALB-1 |
| IL6R31 | Bispecific PMP35E11-9AA GlySer-ALB-1 |
| IL6R32 | Bispecific PMP35F4-9AA GlySer-ALB-1 |
| IL6R33 | Bispecific PMP35H4-9AA GlySer-ALB-1 |
| IL6R34 | Bispecific PMP40H5-9AA GlySer-ALB-1 | a) Binding to IL6-R in Biacore

Affinity constants (Kd) of the 14 bispecific (anti-IL6R/anti-HSA) Nanobodies (table C-14) were determined by surface plasmon resonance on a Biacore 3000 instrument. In brief, IL6-R is amine-coupled to a CM5 sensor chip at a density of 800-1000 RU. Remaining reactive groups are inactivated. Nanobody binding is assessed at various concentrations ranging from 0.5 to 50 nM. Each sample is injected for 4 min at a flow rate of 45 μl/min to allow for binding to chip-bound antigen. Next, binding buffer without Nanobody is sent over the chip at the same flow rate to allow for dissociation of bound Nanobody. After 10 min, remaining bound analyte is removed by injecting regeneration solution (Glycine/HCl pH1.5). Binding curves obtained at different concentrations of Nanobody are used to calculate Kd values. In Table C-14 an overview of $k_d/k_{off}$, $k_a$, and $K_d$ values for the 14 bispecific Nanobodies is shown.

TABLE C-14

Overview of $k_d/k_{off}$, $k_a$-, and $K_d$-values for binding of 14 bispecific (anti-IL6-R/anti-HSA) Nanobodies to IL6-R

| Nanobody ID | $k_d/k_{off}(s^{-1})$ | $k_a$ (1/Ms) | $K_d$ (nM) |
|---|---|---|---|
| IL6R22 | 5.65E−03 | 3.33E+05 | 16.9 |
| IL6R23 | 1.46E−03 | 3.19E+05 | 4.59 |
| IL6R24 | 1.10E−04 | 3.68E+05 | 0.3 |
| IL6R25 | 1.21E−03 | 1.18E+05 | 10.3 |
| IL6R26 | 6.90E−03 | 4.46E+05 | 15.5 |
| IL6R28 | 5.26E−04 | 2.41E+05 | 2.18 |
| IL6R29 | 1.49E−03 | 7.13E+05 | 2.1 |
| IL6R30 | 1.20E−03 | 1.60E+05 | 7.52 |
| IL6R31 | 3.77E−04 | 1.62E+05 | 2.32 |
| IL6R32 | 1.26E−03 | 1.01E+06 | 1.3 |
| IL6R33 | 1.25E−04 | 1.13E+05 | 1.11 |
| IL6R34 | 1.08E−04 | 2.58E+05 | 0.417 | b) Binding to Human and Mouse Serum Albumin in Biacore

Binding of Nanobodies® to serum albumin was characterized by surface plasmon resonance in a Biacore 3000 instrument, and an equilibrium constant, $K_D$, was determined. In brief, serum albumin from different species was covalently bound to CM5 sensor chips surface via amine coupling until an increase of 500 response units was reached. Remaining reactive groups were inactivated. Nanobody® binding was assessed using a series of different concentrations. Each Nanobody® at each concentration was injected for 4 minutes at a flow rate of 45 μl/min to allow for binding to chip-bound antigen. Next, binding buffer without Nanobody® was sent over the chip at the same flow rate to allow dissociation of bound Nanobody®. After 15 mM, remaining bound analyte was removed by injecting regeneration solution (50 mM NaOH).

From the sensorgrams obtained for the different concentrations of each analyte, $K_D$ values were calculated via kinetic data analysis. Results are presented in Table C-15 below.

c) Binding to IL6-R on U266 Cells

Figure 15:
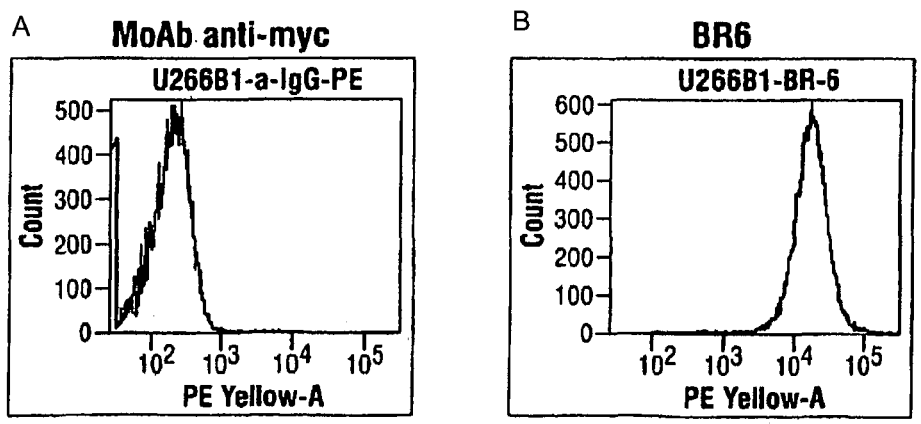

Flow cytometric analysis of bispecific IMAC-purified Nanobodies from selected clones (IL6R23, IL6R24, IL6R29, IL6R33) was done. IMAC-purified Nanobodies were added to IL6-R positive U266 cells. Detection was performed by a monoclonal anti-myc antibody followed by a PE-labeled polyclonal anti-mouse antibody. Nanobodies binding to cells was measured by an increase in fluorescence intensity as compared to cells that were incubated with FACS buffer (PBS+10% FBS) followed by monoclonal anti-myc antibody and/or PE-labeled polyclonal anti-mouse antibody. Results are shown in FIG. 15. Fluorescence intensity is blotted on the X-axis, the number of events on the Y-axis. Purified anti-IL6-R antibody BR-6 was included.

TABLE C-16

Inhibition of the Reference-Fab/IL6R interaction by 14 bispecific (anti-IL6-R/anti-HSA) Nanobodies

| Nanobody ID | % binding retained in competition with Reference-Fab |
|---|---|
| IL6R22 | 71 |
| IL6R23 | 4 |
| IL6R24 | 35 |
| IL6R25 | 44 |
| IL6R26 | 25 |
| IL6R28 | 82 |

TABLE C-15

Overview of $k_d/k_{off}$, $k_a$-, and $K_d$-values for binding of 14 bispecific (anti-IL6-R/anti-HSA) Nanobodies ® to human, mouse, cyno, rhesus and baboon serum albumin

| | Human SA | | | Mouse SA | | | Cyno SA | | |
|---|---|---|---|---|---|---|---|---|---|
| Nanobody ID | $k_d/k_{off}(s^{-1})$ | $k_a$ (1/Ms) | $K_d$ (nM) | $k_d/K_{off}(s^{-1})$ | $k_a$ (1/Ms) | $K_d$ (nM) | $k_d/k_{off}(s^{-1})$ | $k_a$ (1/Ms) | $K_d$ (nM) |
| IL6R22 | 3.27E−03 | 2.94E+05 | 11.1 | 5.08E−02 | 4.72E+05 | 108 | | | |
| IL6R23 | 7.05E−03 | 4.58E+05 | 15.4 | 5.50E−02 | 2.00E+05 | 275 | 2.77E−03 | 1.00E+05 | 27.6 |
| | 3.08E−03 | 1.92E+05 | 16 | | | | | | |
| IL6R24 | 3.31E−03 | 2.21E+05 | 15 | 4.95E−02 | 4.06E+05 | 122 | 3.34E−03 | 1.18E+05 | 28.3 |
| IL6R25 | 3.17E−03 | 2.29E+05 | 13.9 | 4.74E−02 | 3.89E+05 | 122 | | | |
| IL6R26 | 3.13E−03 | 3.33E+05 | 9.39 | 4.38E−02 | 6.01E+05 | 73 | | | |
| IL6R28 | 3.78E−03 | 3.56E+05 | 10.6 | 4.78E−02 | 2.65E+05 | 180 | | | |
| IL6R29 | 3.13E−03 | 2.91E+05 | 10.8 | 4.58E−02 | 5.52E+05 | 83 | 3.07E−03 | 1.62E+05 | 19 |
| IL6R30 | 3.27E−03 | 2.71E+05 | 12.1 | 5.10E−02 | 4.53E+05 | 113 | | | |
| IL6R31 | 3.04E−03 | 2.27E+05 | 13.4 | 4.23E−02 | 4.88E+05 | 86.8 | | | |
| IL6R32 | 3.20E−03 | 3.15E+05 | 10 | 5.00E−02 | 2.78E+05 | 179 | | | |
| IL6R33 | 3.69E−03 | 1.35E+05 | 27.3 | 5.01E−02 | 5.08E+05 | 98.6 | 4.04E−03 | 1.65E+05 | 24.5 |
| IL6R34 | 4.72E−03 | 5.15E+05 | 9.18 | 4.40E−02 | 3.97E+05 | 111 | 3.04E−03 | 2.03E+05 | 15 |
| ALB-1 | 7.16E−04 | 1.24E+06 | 0.58 | 7.25E−03 | 1.11E+06 | 6.5 | | | |

| | | Rhesus SA | | | Baboon SA | | |
|---|---|---|---|---|---|---|---|
| | Nanobody ID | $k_d/K_{off}(s^{-1})$ | $k_a$ (1/Ms) | $K_d$ (nM) | $k_d/k_{off}(s^{-1})$ | $k_a$ (1/Ms) | $K_d$ (nM) |
| | IL6R22 | | | | | | |
| | IL6R23 | 2.67E−03 | 1.12E+05 | 23.8 | 7.47E−03 | 3.22E+05 | 23.2 |
| | IL6R24 | 3.53E−03 | 1.25E+05 | 28.3 | 4.98E−03 | 1.24E+05 | 40.3 |
| | IL6R25 | | | | | | |
| | IL6R26 | | | | | | |
| | IL6R28 | | | | | | |
| | IL6R29 | 3.29E−03 | 1.60E+05 | 20.6 | 4.53E−03 | 1.69E+05 | 26.8 |
| | IL6R30 | | | | | | |
| | IL6R31 | | | | | | |
| | IL6R32 | | | | | | |
| | IL6R33 | 3.83E−03 | 1.56E+05 | 24.6 | 6.26E−03 | 1.94E+05 | 32.3 |
| | IL6R34 | 3.17E−03 | 2.15E+05 | 14.7 | 4.31E−03 | 2.28E+05 | 18.9 |
| | ALB-1 | | | | | | | d) Epitope Mapping

Bispecific Nanobodies were analyzed for competition with Reference-Fab. The 14 purified bispecific Nanobodies were tested in Alphascreen for inhibition of the Reference-Fab/IL6R interaction. A fixed concentration of purified proteins (100 nM) was added to biotinylated IL6-R (1 nM) and incubated for 15 min. Subsequently Reference-Fab-coated acceptor beads were added and this mixture was incubated for 1 hour. Finally streptavidin donor beads were added and after 1 hour incubator the plate was read on the Envision microplate reader. BR-6, BN12 and the Reference-Fab were included as reference. Results, shown in Table C-16, are expressed as the % binding retained in competition with Reference-Fab. The lower the number, the higher the competition, the higher the overlap in epitope.

TABLE C-16-continued

Inhibition of the Reference-Fab/IL6R interaction by 14 bispecific (anti-IL6-R/anti-HSA) Nanobodies

| Nanobody ID | % binding retained in competition with Reference-Fab |
|---|---|
| IL6R29 | 37 |
| IL6R30 | 78 |
| IL6R31 | 37 |
| IL6R32 | 58 |
| IL6R33 | 17 |
| IL6R34 | 31 | e) Antagonistic Activity in Alphascreen

Figure 16:
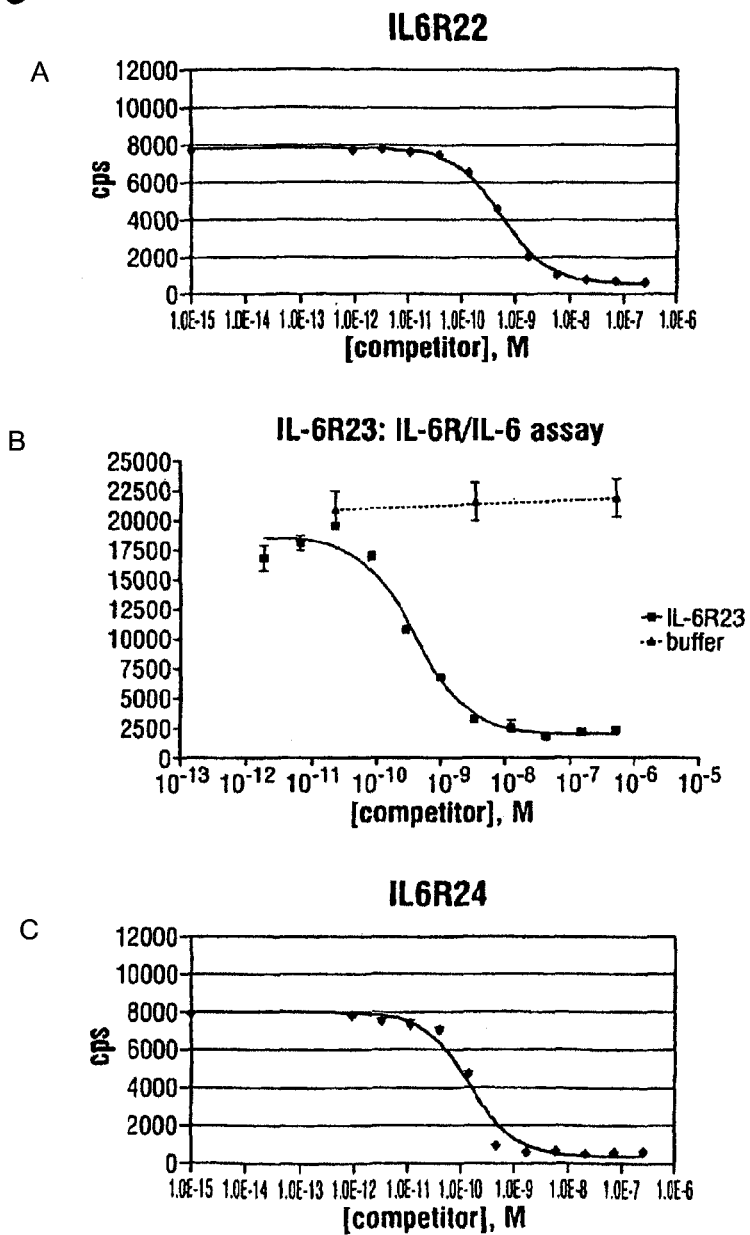
Figure 17:
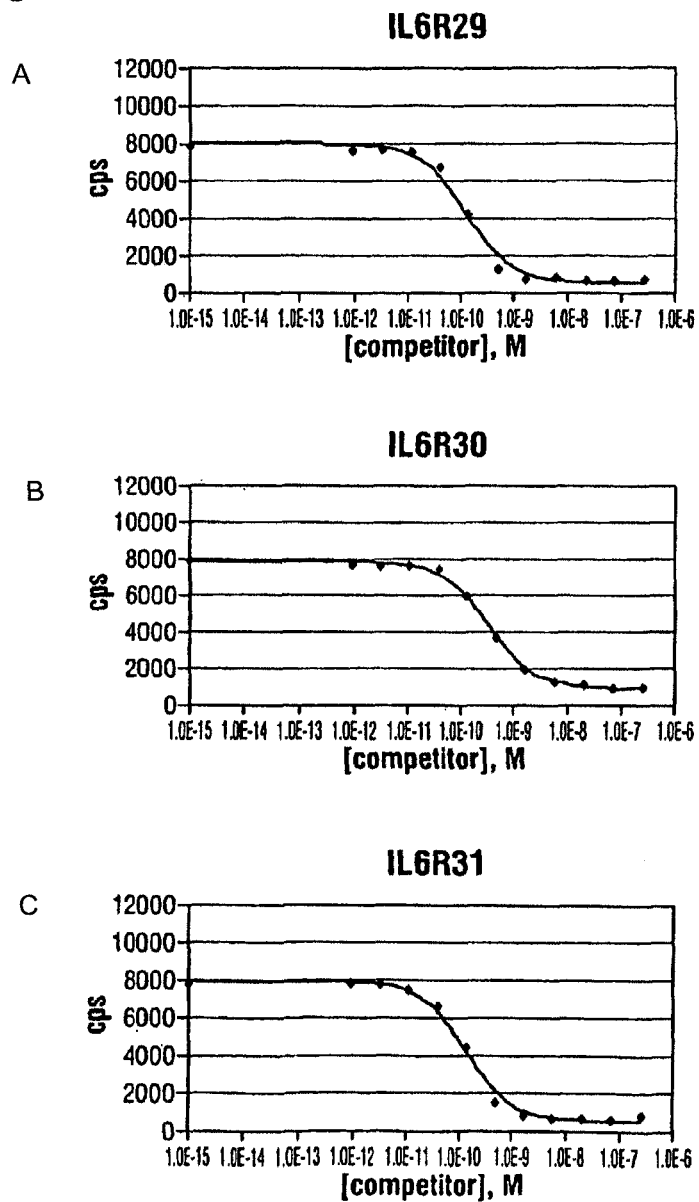
FIG. 17A: Panel D-F) Antagonistic activity of bispecific anti IL6R/anti SA Nanobodies in Alphascreen for inhibition of the IL6/IL6-R interaction.
Figure 17:
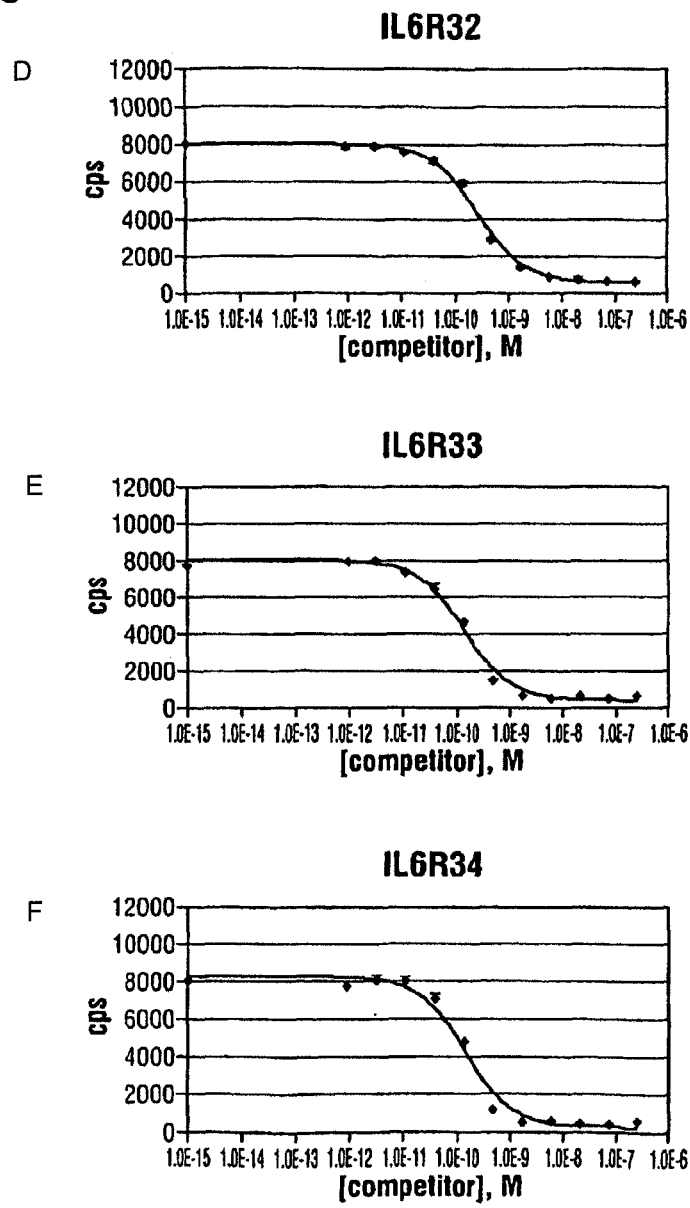

The 14 purified bispecific Nanobodies were tested in Alphascreen for inhibition of the IL6/IL6R interaction. Serial dilutions of purified proteins (concentration range: 500 nM-10 pM) were added to IL6-R (0.3 nM) and incubated for 15 min. Subsequently 3 nM bio-IL6 and BN12-coated acceptor beads were added and this mixture was incubated for 1 hour. Finally streptavidin donor beads were added and after 1 hour incubator the plate was read on the Envision microplate reader. BR-6 and the Reference-Fab fragment were included as reference. Dose-response curves, shown in FIGS. 16 and 17, were observed for Nanobodies with $IC_{50}$-values ranging from 55 pM to 1.7 nM (Table C-17).

TABLE C-17

IC50 values of 14 bispecific (anti-IL6-R/anti-HSA) Nanobodies

| ID | IC50 (M) |
|---|---|
| IL6R21 | |
| IL6R22 | 5.594E−10 |
| IL6R23 | |
| IL6R24 | 1.451E−10 |
| IL6R25 | 6.429E−10 |
| IL6R26 | 1.666E−09 |
| IL6R27 | |
| IL6R28 | 3.259E−10 |
| IL6R29 | 1.234E−10 |
| IL6R30 | 3.431E−10 |
| IL6R31 | 1.309E−10 |
| IL6R32 | 2.678E−10 |
| IL6R33 | 1.386E−10 |
| IL6R34 | 1.455E−10 | f) Antagonistic Activity in Cell-Based Assay (XG-1)

Figure 18:
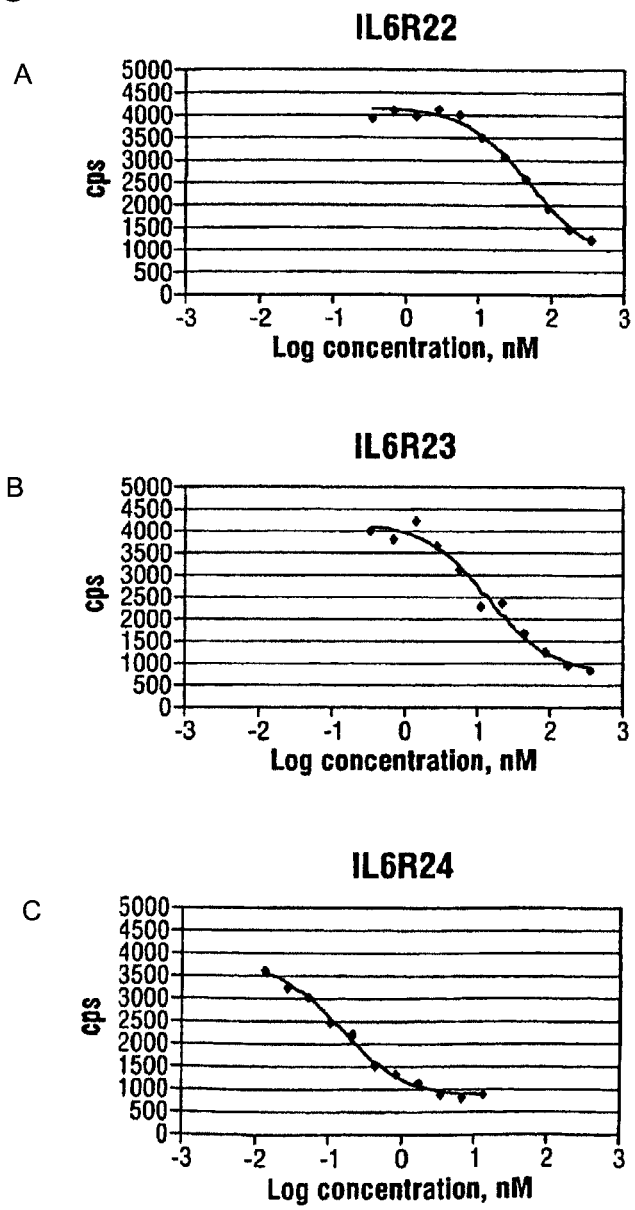
Figure 18:
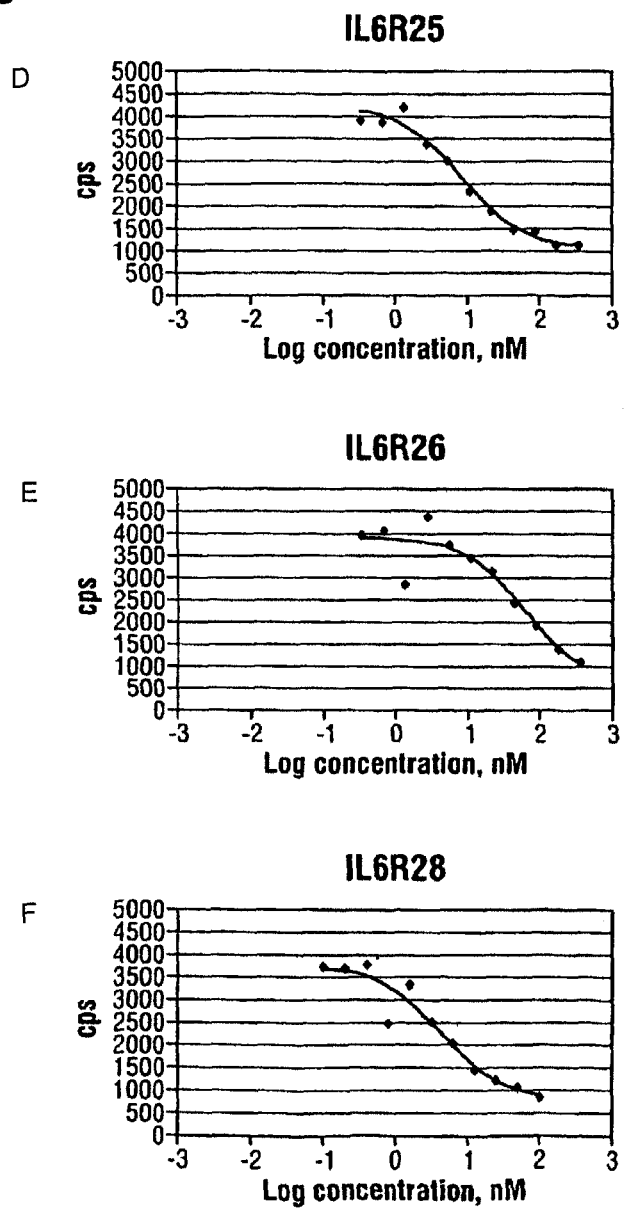
Figure 20:
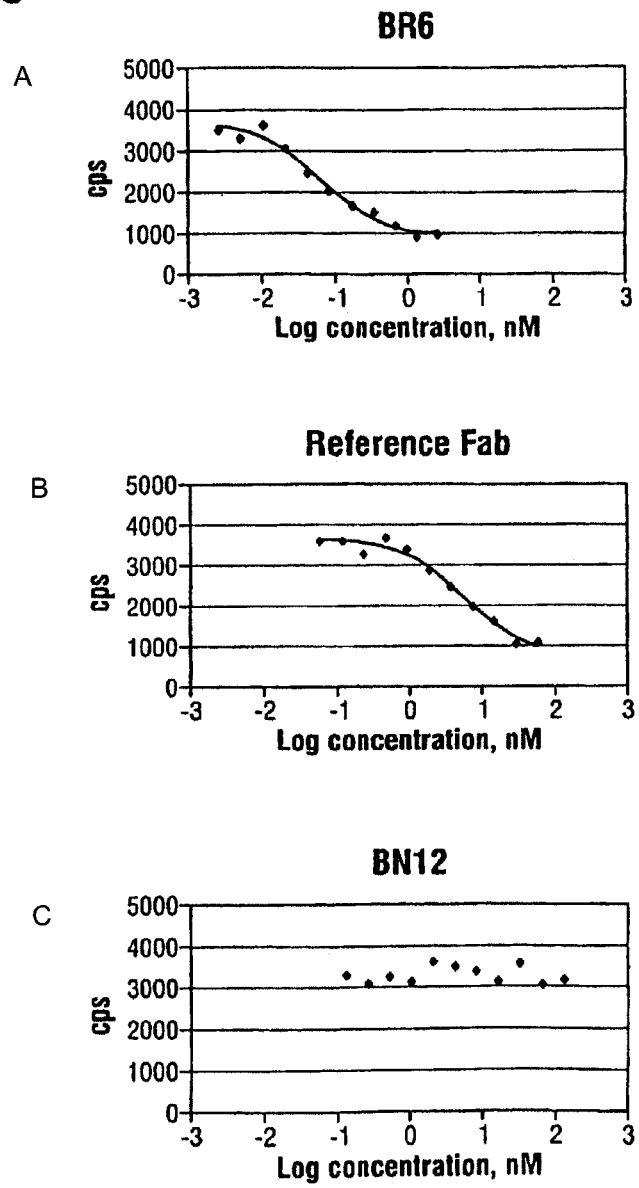

All 14 bispecific Nanobodies were tested in the XG1 assay. XG1 is an IL6-dependent human myeloma cell line. Half-maximal proliferation is achieved at ~20 pg/ml of IL6. Assays were essentially performed as described by Zhang et al. (Blood 83: 3654-3663). BR6, BN12 and the Reference-Fab were included as a reference. Results are outlined in FIGS. 18, 19 and 20. IC50 values ranged from 50 nM to 90 pM and are presented in Table C-18.

TABLE C-18

IC50 values of 14 bispecific (anti-IL6-R/anti-HSA) Nanobodies measured in XG-1 cell based assay

| ID | IC50 (nM) |
|---|---|
| IL6R21 | |
| IL6R22 | 50.17 |
| IL6R23 | 13.97 |
| IL6R24 | 0.1542 |
| IL6R25 | 8.363 |
| IL6R26 | 65.33 |
| IL6R27 | |
| IL6R28 | 4.364 |
| IL6R29 | 3.022 |
| IL6R30 | 27.16 |
| IL6R31 | 4.566 |
| IL6R32 | 1.61 |
| IL6R33 | 1.574 |
| IL6R34 | 0.339 |

Figure 22:
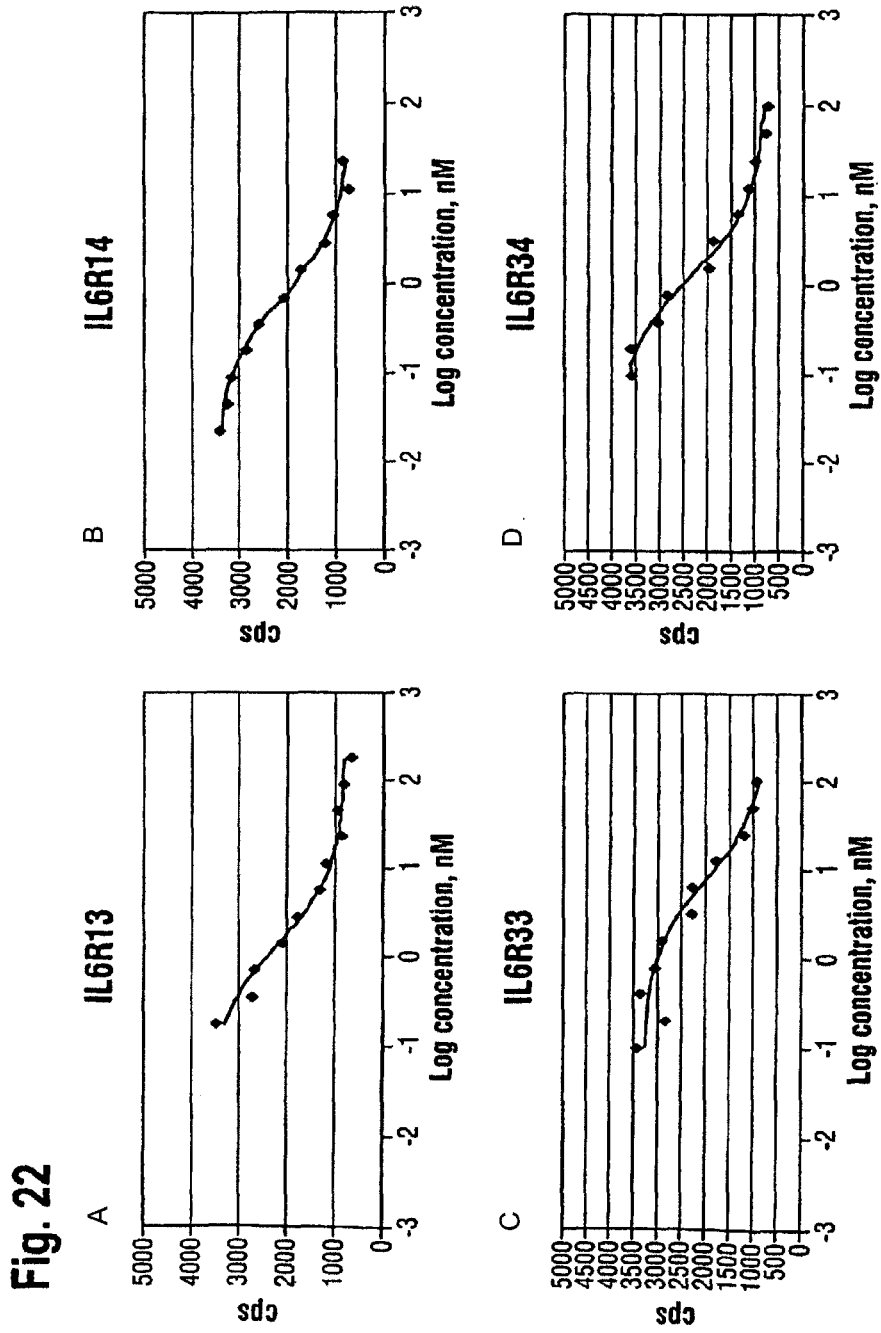

Nanobodies were also analyzed in the presence of 1 mg/mL human serum albumin. IC50 values range from 17 nM to 100 pM for monovalent Nanobodies and from 37 nM to 670 pM for bispecific Nanobodies. Results are shown in FIGS. 21 and 22 and Table C-19.

TABLE C-19

IC50 values of monovalent (anti-IL6R) and bispecific (anti-IL6-R/anti-HSA) Nanobodies measured in XG-1 cell based assay

| ID | IC50 (nM) |
|---|---|
| IL6R03 | 17.54 |
| IL6R04 | 0.099 |
| IL6R09 | 2.985 |
| IL6R13 | 1.321 |
| IL6R14 | 0.751 |
| IL6R23 | 37.26 |
| IL6R24 | 0.667 |
| IL6R29 | 8.691 |
| IL6R33 | 8.071 |
| IL6R34 | 1.356 |

Example 9

Construction, Expression and Purification of Trivalent Anti-IL6-R Nanobodies

Figure 23:
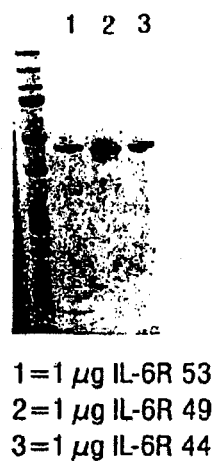
FIG. 23 SDS-PAGE of purified trivalent anti IL6R/anti SA Nanobodies. M=molecular weight markers. The identity of the Nanobodies is shown on top of the gel.

Nanobodies were also expressed as trivalent bispecifics consisting of an N-terminal anti-IL6R Nanobody, a C-terminal anti-IL6R Nanobody and an anti-HSA Nanobody (ALB-1) in the middle, connecting the different building blocks with a 9 amino acid Gly/Ser linker (SEQ ID NO's 478 to 492). These constructs were expressed in *E. coli* as c-myc, His6-tagged proteins and subsequently purified from the culture medium by immobilized metal affinity chromatography (IMAC) and size exclusion chromatography (SEC). SDS-PAGE of purified Nanobodies is shown in FIG. 23.

Example 10

Figure 24:
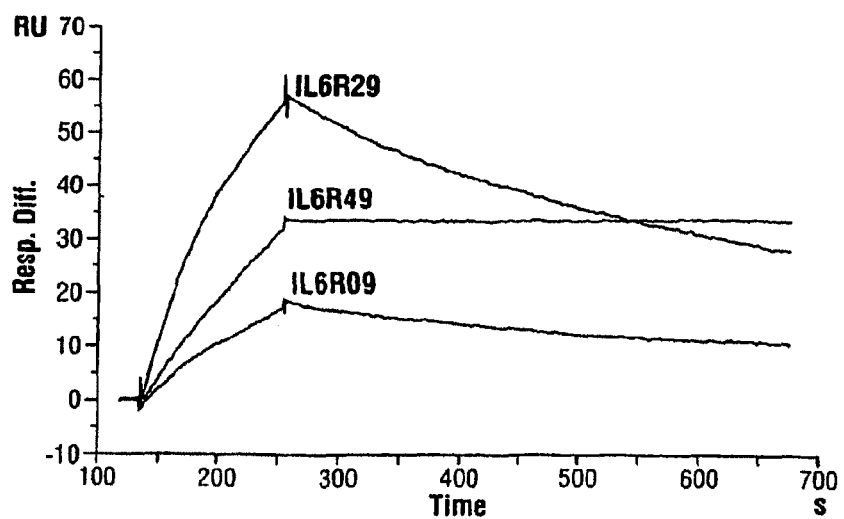
FIG. 24 Binding of trivalent anti IL6R/anti SA Nanobodies to IL6-R in Biacore.

Characterization of Trivalent Anti-IL6-R Nanobodies a) Binding to IL6R on Biacore Affinity constants (Kd) of the 3 trivalent Nanobodies were determined by surface plasmon resonance on a Biacore 3000 instrument. In brief, IL6-R is amine-coupled to a CM5 sensor chip at a density of 800-1000 RU. Remaining reactive groups are inactivated. Nanobody binding is assessed at various concentrations ranging from 0.5 to 50 nM. Each sample is injected for 4 min at a flow rate of 45 µl/min to allow for binding to chip-bound antigen. Next, binding buffer without Nanobody is sent over the chip at the same flow rate to allow for dissociation of bound Nanobody. After 10 min, remaining bound analyte is removed by injecting regeneration solution (Glycine/HCl pH1.5). Avid binding could be demonstrated for the trivalent Nanobody IL6R49 (SEQ ID NO 480) as compared to the corresponding monovalent Nanobody IL6R09 or the bispecific Nanobody IL6R29 (FIG. 24).

b) Binding to IL6R on U266 Cells

Figure 25:
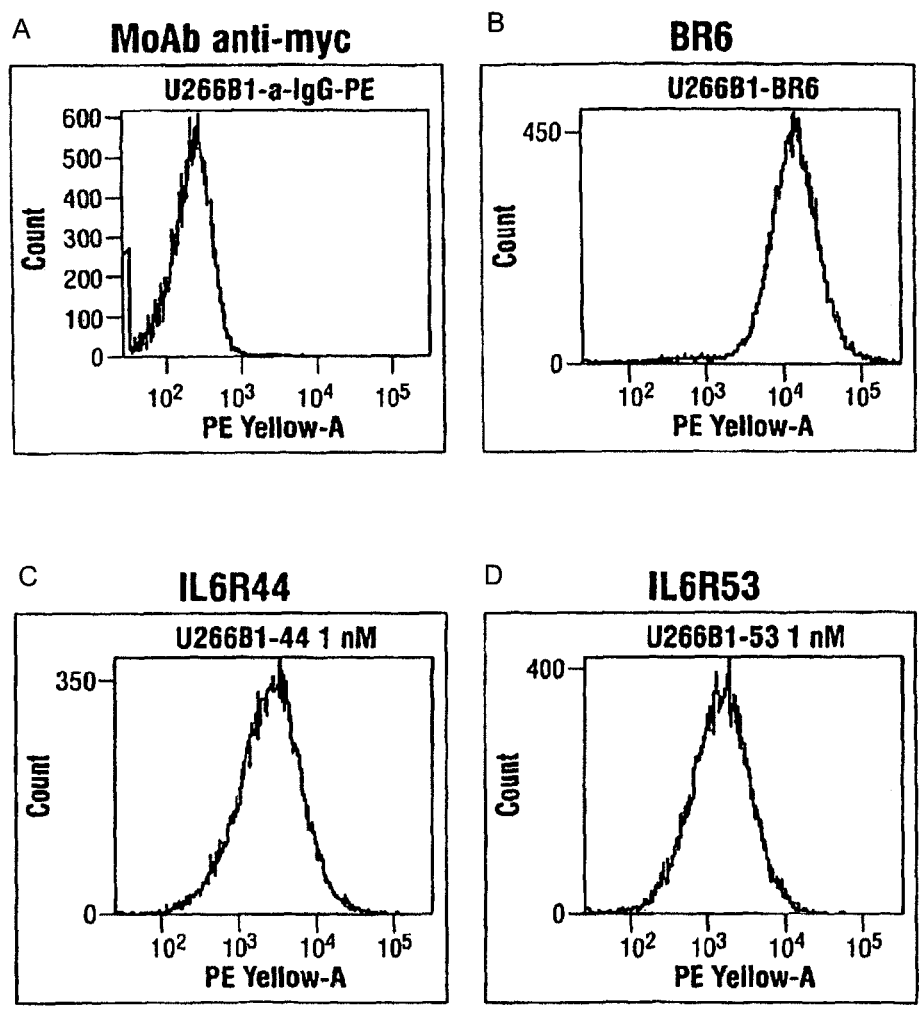
FIG. 25 (Panel A-D) Binding of trivalent anti IL6R/anti SA Nanobodies to IL6-R on U266 cells. Fluorescence intensity is blotted on the X-axis, the number of events on the Y-axis. Purified anti-IL6-R antibody BR-6 was included.

Flow cytometric analysis of bispecific trivalent IMAC-purified Nanobodies from selected clones (IL6R44 (SEQ ID NO 479), IL6R53 (SEQ ID NO 481)). IMAC-purified Nanobodies were added to IL6-R positive U266 cells. Detection was performed by a monoclonal anti-myc antibody followed by a PE-labeled polyclonal anti-mouse antibody. Nanobodies binding to cells was measured by an increase in fluorescence intensity as compared to cells that were incubated with FACS buffer (PBS+10% FBS) followed by monoclonal anti-myc antibody and/or PE-labeled polyclonal anti-mouse antibody. Results are shown in FIG. 25. Fluorescence intensity is blotted on the X-axis, the number of events on the Y-axis. Purified anti-IL6-R antibody BR-6 was included.

c) Antagonistic Activity in Cell Based Assay (XG-1)

Figure 26:
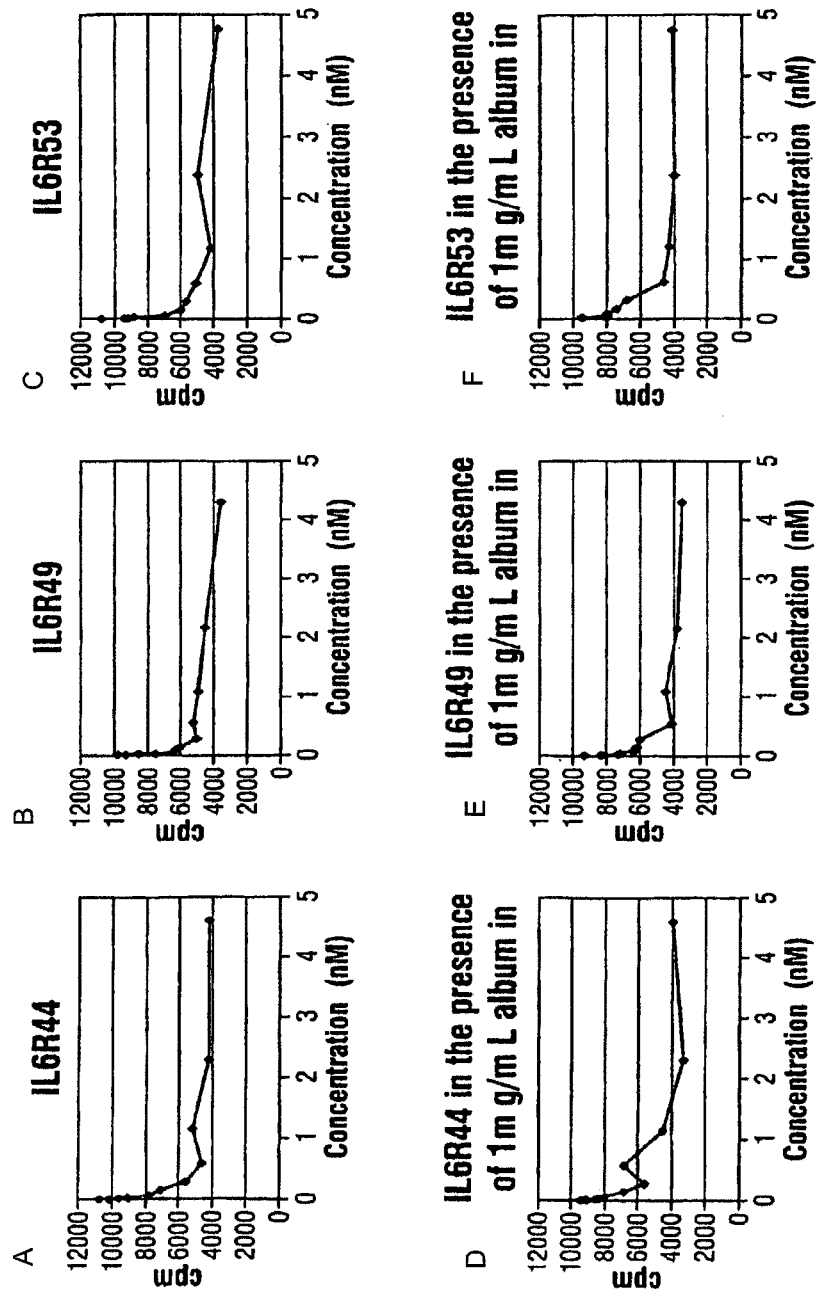
FIG. 26 (Panel A-F) Antagonistic activity of trivalent anti IL6R/anti SA Nanobodies in the absence and in the presence of 1 mg/mL human serum albumin in cell-based assay (XG-1).
Figure 28:
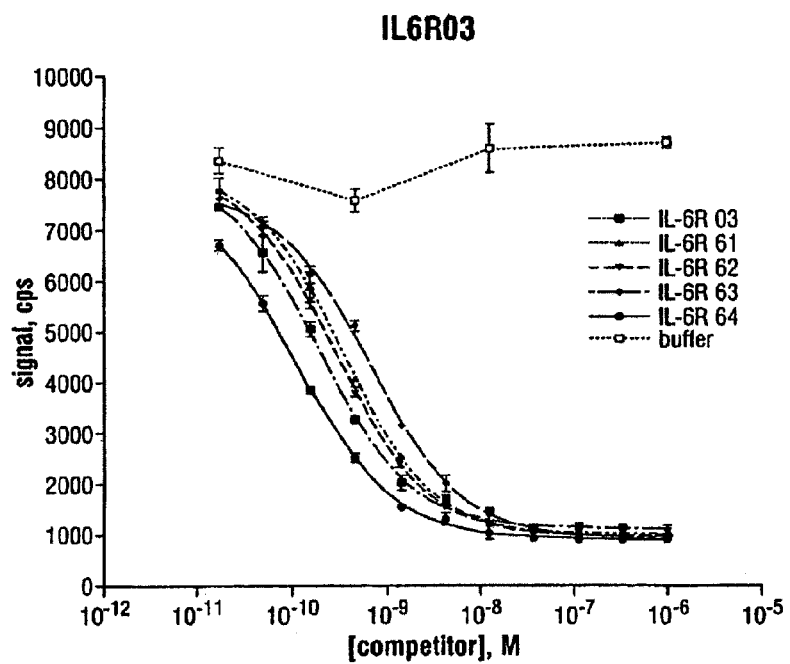
FIGS. 28, 29, 30 and 31 Antagonistic activity of humanized variants of IL6R03, IL6R04 and IL6R13 anti IL6R Nanobodies in Alphascreen for inhibition of the IL6/IL6-R interaction.
Figure 29:
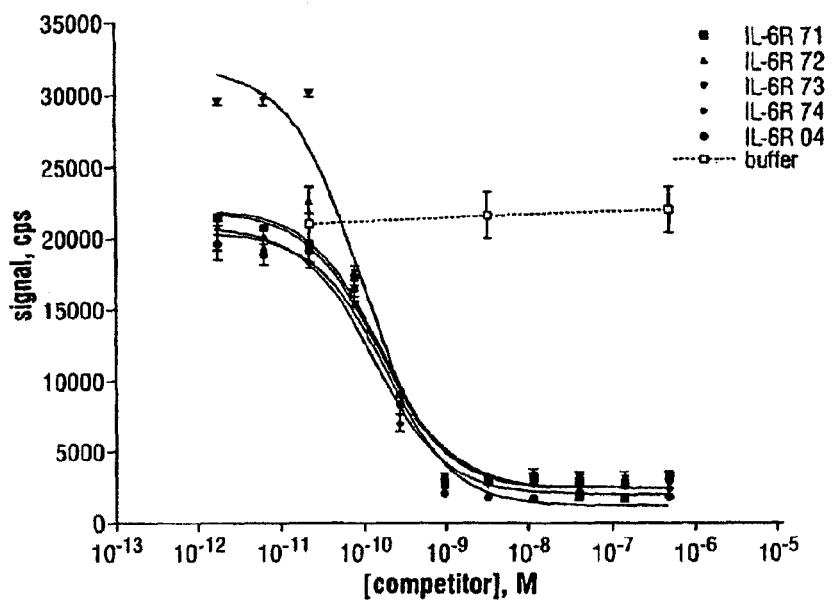
Figure 30:
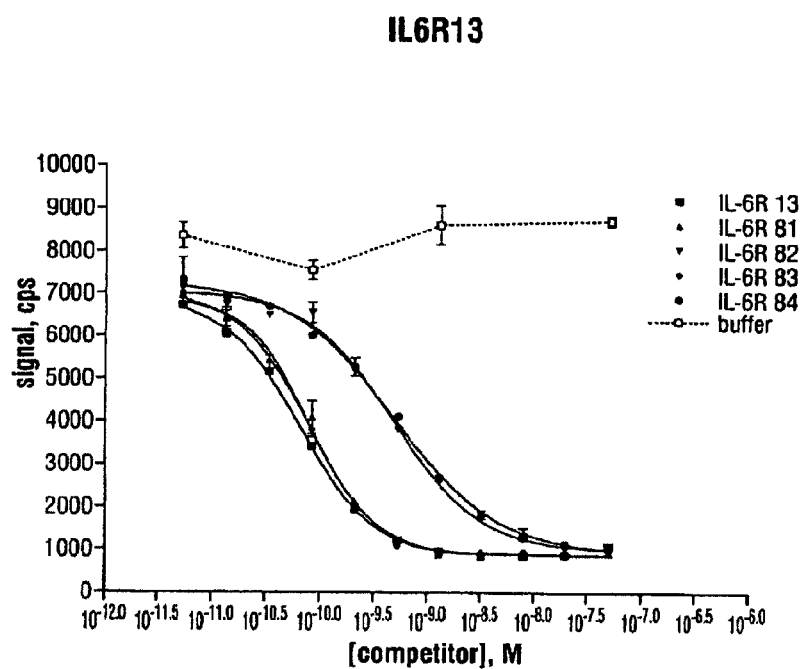
Figure 31:
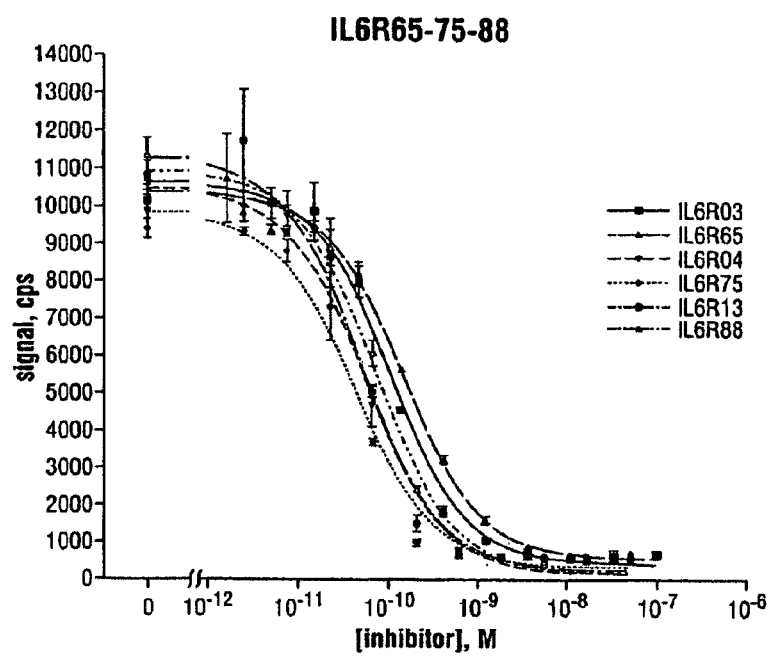

Purified trivalent Nanobodies IL6R44, IL6R49 and IL6R53 (SEQ ID NO's 479, 480 and 481) were tested in the XG1 assay. XG1 is an IL6-dependent human myeloma cell line. Half-maximal proliferation is achieved at ~20 pg/ml of IL6. Assays were essentially performed as described by Zhang et al. (Blood 83: 3654-3663). BR6, BN12 and the Reference-Fab were included as a reference. Results are outlined in FIG. 26.

Example 11

Binding to Human, Cynomolgus Monkey and Mouse Serum Albumin in Biacore of Wild Type Trivalent Nanobody® Constructs Binding of Nanobodies® to serum albumin was characterized by surface plasmon resonance in a Biacore 3000 instrument, and an equilibrium constant, $K_D$, was determined. In brief, serum albumin from different species was covalently bound to CM5 sensor chips surface via amine coupling until an increase of 500 response units was reached. Remaining reactive groups were inactivated. Nanobody® binding was assessed using a series of different concentrations. Each Nanobody® at each concentration was injected for 4 minutes at a flow rate of 45 μl/min to allow for binding to chip-bound antigen. Next, binding buffer without Nanobody® was sent over the chip at the same flow rate to allow dissociation of bound Nanobody®. After 15 min, remaining bound analyte was removed by injecting regeneration solution (50 mM NaOH).

From the sensorgrams obtained for the different concentrations of each analyte, $K_D$ values were calculated via kinetic data analysis. Results are presented in Table C-20 below.

TABLE C-20

Kd values of trivalent bispecific Nanobodies to serum albumin from different species

| Nanobody ID | Human SA | Mouse SA | Cyno SA |
|---|---|---|---|
| IL6R44 | 51.4 nM | 993 nM | 43 nM |
| IL6R53 | 35 nM | 497 nM | Not determined |

Example 12

Humanization

DNA fragments encoding humanized versions of Nanobodies® IL6R03, IL6R04 and IL6R13 were assembled from oligonucleotides using a PCR overlap extension method (Stemmer et al., 1995). The sequences of different variants are shown in FIG. 27.

a) Antagonistic Activity in Alpha Screen

Humanized clones of IL6R03 (IL6R61, IL6R62, IL6R63, IL6R64 and IL6R65; SEQ ID NOs: 609 to 613), IL6R04 (IL6R71, IL6R72, IL6R73, IL6R74 and IL6R75; SEQ ID NOs: 614 to 618) and IL6R13 (IL6R81, IL6R82, IL6R83, IL6R84 and IL6R88; SEQ ID NOs: 619, 620, 621, 622 and 626, respectively) were tested in Alphascreen for inhibition of the IL6/IL6R interaction. Serial dilutions of purified proteins (concentration range: 500 nM-10 pM) were added to IL6-R (0.3 nM) and incubated for 15 min. Subsequently 3 nM bio-IL6 and BN12-coated acceptor beads were added and this mixture was incubated for 1 hour. Finally streptavidin donor beads were added and after 1 hour incubator the plate was read on the Envision microplate reader. BR-6 and the Reference-Fab fragment were included as reference. Dose-response curves are shown in FIGS. 28, 29, 30 and 31. No significant differences between the final different humanized clones (IL6R65, IL6R75 and IL6R88) and their corresponding non-humanized versions (IL6R03, IL6R04 and IL6R13, respectively) were observed.

b) Temperature Stability Tests

Figure 32:
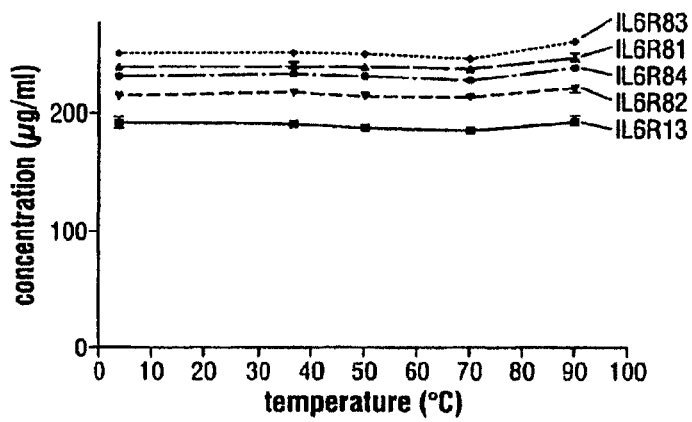
FIGS. 32 and 33 Concentration of humanized variants of IL6R03, IL6R04 and IL6R13 anti IL6R Nanobodies after incubation at different temperatures.
Figure 33:
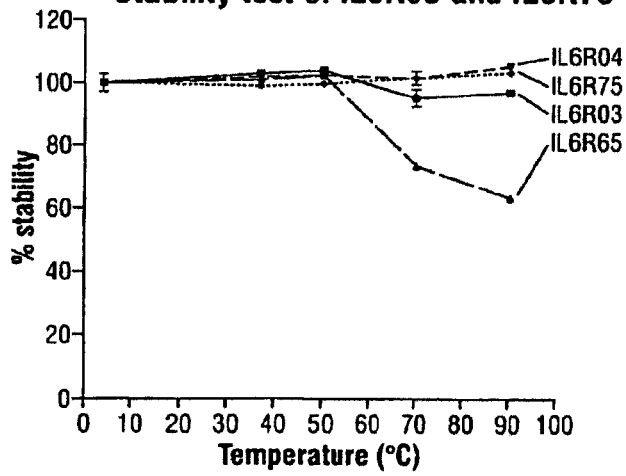

Temperature stability tests were performed for humanized clones of IL6R03 (IL6R65), IL6R04 (IL6R75) and IL6R13 (IL6R81, IL6R82, IL6R83 and IL6R84). Samples were diluted at 200 μg/ml and divided in 5*2 aliquots containing 60 μl. The different vials were incubated each at a given temperature ranging from 37° C. to 90° C. (37, 50, 70 and 90° C.) for a period of 1 hr. (lid temperature: 105° C.) (control was stored at 4° C.). Thereafter, the samples were hold at 25° C. for 2 hrs (ramping rate: 0.05) and stored over night at 4° C. Precipitates were removed by centrifugation for 30 min at 14.000 rpm. Supernatant was carefully removed and further analysed. OD at 280 nm was measured and the concentration was calculated based on the extinction coefficients. Results are shown in FIGS. 32 and 33.

c) Binding to IL6-R in Biacore

Humanized clones of IL6R03 (IL6R61, IL6R62, IL6R63, IL6R64 and IL6R65), IL6R04 (IL6R71, IL6R72, IL6R73, IL6R74 and IL6R75) and IL6R13 (IL6R81, IL6R82, IL6R83, IL6R84 and IL6R88) were selected for off-rate analysis on Biacore and DNA sequencing (Table C-21 and FIG. 27).

Affinity constants (Kd) of these Nanobodies were determined by surface plasmon resonance on a Biacore 3000 instrument. In brief, IL6-R is amine-coupled to a CM5 sensor chip at a density of 800-1000 RU. Remaining reactive groups are inactivated. Nanobody binding was assessed at various concentrations ranging from 0.5 to 50 nM. Each sample was injected for 4 min at a flow rate of 45 μl/min to allow for binding to chip-bound antigen. Next, binding buffer without Nanobody was sent over the chip at the same flow rate to allow for dissociation of bound Nanobody. After 10 min, remaining bound analyte was removed by injecting regeneration solution (Glycine/HCl pH1.5). Binding curves obtained at different concentrations of Nanobody were used to calculate Kd values. In Table C-21, an overview of $k_d$, $k_a$, and $K_d$ values for the humanized Nanobodies is shown.

TABLE C-21

Overview of $K_D$, $k_a$ and $k_d$ values for binding of humanized anti-IL-6 receptor Nanobodies ® to the human Il-6 receptor.

| | | IL6R |
|---|---|---|
| IL6R61 | KD (nM) | 2 |
| | ka (1/Ms) | 8.50E+05 |
| | kd (1/s) | 1.70E−03 |
| IL6R62 | KD (nM) | 2.22 |
| | ka (1/Ms) | 9.29E+05 |
| | kd (1/s) | 2.07E−03 |
| IL6R63 | KD (nM) | 3.69 |
| | ka (1/Ms) | 9.90E+05 |
| | kd (1/s) | 3.65E−03 |
| IL6R64 | KD (nM) | |
| | ka (1/Ms) | |
| | kd (1/s) | 1.00E−03 |
| IL6R65 | KD (nM) | 4 |
| | ka (1/Ms) | 6.00E+05 |
| | kd (1/s) | 2.35E−03 |

TABLE C-21-continued

Overview of $K_D$, $k_a$ and $k_d$ values for binding of humanized anti-IL-6 receptor Nanobodies ® to the human Il-6 receptor.

| | | IL6R |
|---|---|---|
| IL6R71 | KD (nM) | 0.22 |
| | ka (1/Ms) | 7.03E+05 |
| | kd (1/s) | 1.53E−04 |
| IL6R72 | KD (nM) | 0.33 |
| | ka (1/Ms) | 5.43E+05 |
| | kd (1/s) | 1.80E−04 |
| IL6R73 | KD (nM) | 0.33 |
| | ka (1/Ms) | 6.98E+05 |
| | kd (1/s) | 2.33E−04 |
| IL6R74 | KD (nM) | 0.16 |
| | ka (1/Ms) | 7.67E+05 |
| | kd (1/s) | 1.22E−04 |
| IL6R75 | KD (nM) | <0.1 |
| | ka (1/Ms) | 1.00E+06 |
| | kd (1/s) | <1E−04 |
| IL6R81 | KD (nM) | 0.4 |
| | ka (1/Ms) | 3.20E+05 |
| | kd (1/s) | 1.28E−04 |
| IL6R82 | KD (nM) | 5.07 |
| | ka (1/Ms) | 6.19E+05 |
| | kd (1/s) | 3.14E−03 |
| IL6R83 | KD (nM) | 0.34 |
| | ka (1/Ms) | 3.50E+05 |
| | kd (1/s) | 1.20E−04 |
| IL6R84 | KD (nM) | 5.36 |
| | ka (1/Ms) | 7.62E+05 |
| | kd (1/s) | 4.09E−03 |
| IL6R85 | KD (nM) | |
| | ka (1/Ms) | |
| | kd (1/s) | 2.06E−03 |
| IL6R86 | KD (nM) | |
| | ka (1/Ms) | |
| | kd (1/s) | 1.70E−03 |
| IL6R87 | KD (nM) | |
| | ka (1/Ms) | |
| | kd (1/s) | 1.05E−04 |
| IL6R88 | KD (nM) | 0.9 |
| | ka (1/Ms) | 2.30E+05 |
| | | 2.13E−04 |
| | kd (1/s) | 3.10E−04 |
| IL6R89 | KD (nM) | |
| | ka (1/Ms) | |
| | kd (1/s) | 1.90E−04 |
| IL6R90 | KD (nM) | |
| | ka (1/Ms) | |
| | kd (1/s) | 1.92E−03 |

Example 13

Antagonistic Activity in Cell-Based Assay (XG-1) of Humanized Nanobodies

Figure 34:
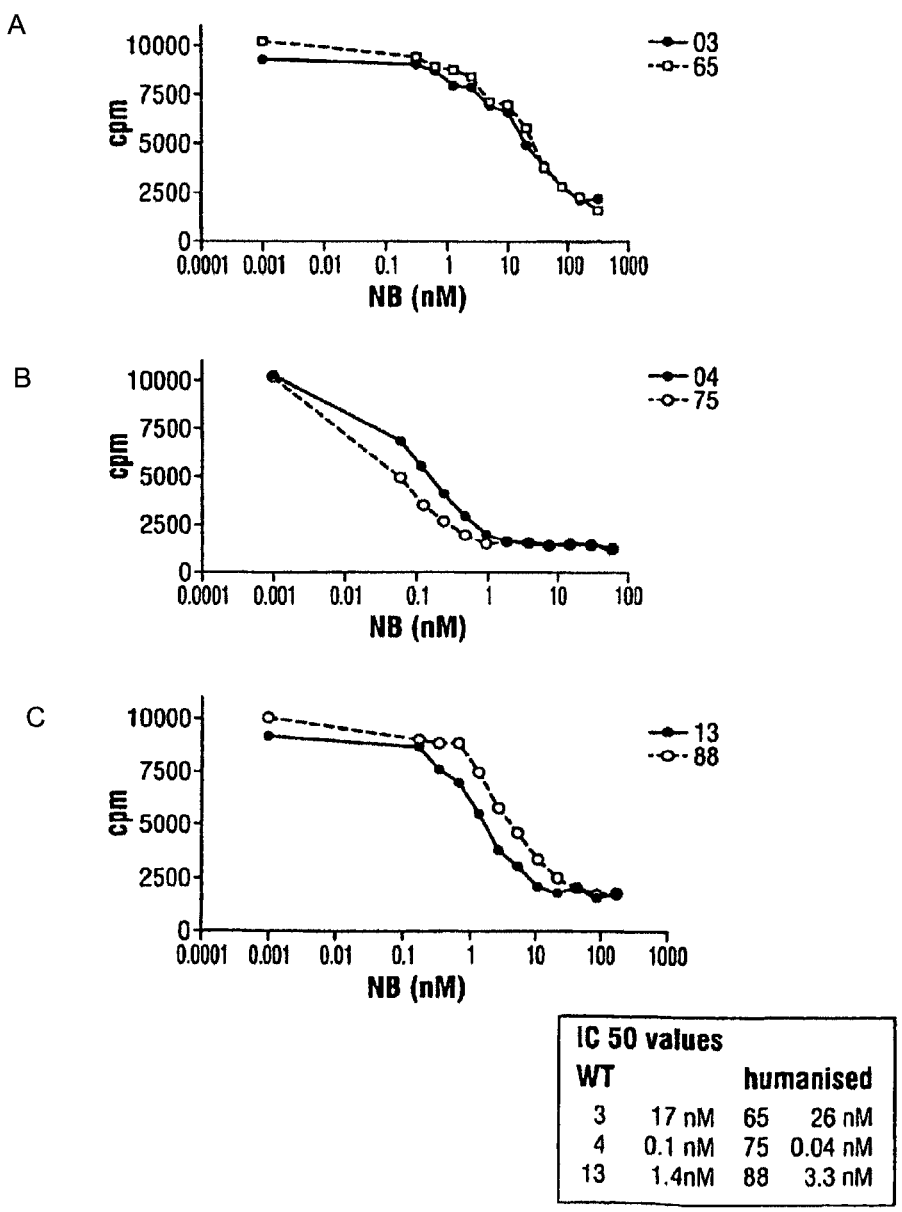
FIG. 34 (Panel A-C) Antagonistic activity in cell-based assay (XG-1) of humanized Nanobodies.

Humanized Nanobodies were analysed in the XG-1 assay. XG-1 is an IL6-dependent human myeloma cell line. Half-maximal proliferation is achieved using ~20 pg/ml IL6. Assays were performed as described by Zhang et al. (Blood 83: 3654-3663). BR6, BN12 were included as a reference. Results are shown in FIG. 34.

Example 14

Construction of Bivalent and Trivalent Humanized Nanobodies

Nanobodies were constructed to bivalent (SEQ ID NO's 559 to 602) and trivalent (SEQ ID NO's 493 to 558) constructs using the humanized anti-IL6R building blocks and humanized anti-serum albumin building blocks. A 9-amino acid GlySer linker was used to link the different building blocks. These constructs were expressed in *E. coli* and purified using ProtA followed by size exclusion chromatography (SEC).

Example 15

Binding to IL6-R in Biacore of Humanized Bivalent and Trivalent Nanobodies

Affinity constants (Kd) of the bispecific bivalent and trivalent humanized Nanobodies were determined by surface plasmon resonance on a Biacore 3000 instrument. In brief, IL6-R was amine-coupled to a CM5 sensor chip at a density of 800-1000 RU. Remaining reactive groups were inactivated. Nanobody binding was assessed at various concentrations ranging from 0.5 to 50 nM. Each sample was injected for 4 min at a flow rate of 45 µl/min to allow for binding to chip-bound antigen. Next, binding buffer without Nanobody was sent over the chip at the same flow rate to allow for dissociation of bound Nanobody. After 10 min, remaining bound analyte was removed by injecting regeneration solution (Glycine/HCl pH 1.5). Binding curves obtained at different concentrations of Nanobody were used to calculate Kd values. In Table C-22 an overview of $k_d/k_{off}$, $k_a$, and $K_d$ values for the bispecific Nanobodies is shown.

TABLE C-22

Overview of $k_d/k_{off}$, $k_a$ and $K_d$-values for binding of bispecific humanized bivalent and trivalent Nanobodies to IL6-R

| Nanobody ID | $k_d/k_{off}(s^{-1})$ | $k_a$ (1/Ms) | $K_d$ (nM) |
|---|---|---|---|
| IL6R202 | 5.7-4.5E+05 | 1.4-1.45E−04 | 0.25-0.32 |
| IL6R203 | 3.8E+05 | ~1.5E−05 | ~0.040 |

Example 16

Binding to Serum Albumin from Different Species of Humanized Bivalent and Trivalent Nanobodies Binding of Nanobodies® to serum albumin was characterized by surface plasmon resonance in a Biacore 3000 instrument, and an equilibrium constant, $K_D$, was determined. In brief, serum albumin from different species was covalently bound to CM5 sensor chips surface via amine coupling until an increase of 500 response units was reached. Remaining reactive groups were inactivated. Nanobody® binding was assessed using a series of different concentrations. Each Nanobody® at each concentration was injected for 4 minutes at a flow rate of 45 µl/min to allow for binding to chip-bound antigen. Next, binding buffer without Nanobody® was sent over the chip at the same flow rate to allow dissociation of bound Nanobody®. After 15 min, remaining bound analyte was removed by injecting regeneration solution (50 mM NaOH).

From the sensorgrams obtained for the different concentrations of each analyte, $K_D$ values were calculated via kinetic data analysis. Results are presented in Table C-23 below.

TABLE C-23

Overview of $k_d/k_{off}$, $k_a$ and $K_d$-values for binding of humanized bivalent and trivalent Nanobodies to serum albumin from different species

Cyno serum albumin

| Nanobody ID | $k_d/k_{off}(s^{-1})$ | $k_a$ (1/Ms) | $K_d$ (nM) |
|---|---|---|---|
| IL6R202 | 1.19E+05 | 5.20E−03 | 43.6 |
| IL6R203 | 8.06E+04 | 4.36E−03 | 54.1 |

Mouse serum albumin

| Nanobody ID | $K_d$ (nM) |
|---|---|
| IL6R202 | 493 |
| IL6R203 | 1009 |

Human serum albumin

| Nanobody ID | $k_d/k_{off}(s^{-1})$ | $k_a$ (1/Ms) | $K_d$ (nM) |
|---|---|---|---|
| IL6R202 | 1.07E+5 | 5.56E−03 | 52.1 |
| IL6R203 | 6.47E+04 | 4.53E−03 | 70 |

Example 17

Antagonistic Activity in Cell-Based Assay (TF-1)

The TF-1 cell (ECACC) line was maintained between 2-9× 100,000 cells/mL using RPMI 1640 supplemented with 2 mM Glutamine, 1% Sodium pyruvate, 3 ng/mL Human GM-CSF (eBiosciences) and 10% Foetal Bovine serum (Gibco). Cells were subcultured 3 times a week and were maintained at 37% and a 5% $CO_2$ atmosphere. The same batch of GM-CSF (Lot E019991) and of Foetal Bovine Serum (lot no 41Q4556K) was used.

The cell-based assay was performed similarly as described in de Hon, F. D., Ehlers, M., Rose-John, S., Ebeling, S. B., Bos, H. K., Aarden, L. A., and Brakenhoff, J. P. (1994) J Exp Med 180, 2395-2400. Cell suspensions were centrifuged for 5 min at 200 g and the supernatant was removed. Cells were resuspended in RPMI 1640 supplemented with 2 mM Glutamine, 1% Sodium pyruvate and 10% Foetal Bovine serum, were seeded at a density of 12500 cells/well in a 96-well plate and incubated for 72 h with different dilutions of Nanobodies® and a constant amount of 500 pg/mL IL-6. The 96-well plates were incubated in a humid chamber. Every sample was analysed in triplicate. The total volume/well was 200 μL. During the last 6 h of the incubation, cells were pulse-labeled with 0.2 μCi/well of $^3$H-thymidine (GE Healthcare) in a total volume of 20 μL. Cells were harvested with a semiautomatic cell harvester (Filtermate harvester, PerkinElmer) and the $^3$H-thymidine incorporation was measured using a Topcount NXT counter (PerkinElmer). Results are expressed as average counts per minute (cpm) per well. IC 50 values are summarised in Table C-24.

TABLE C-24

IC50 values obtained in TF-1 assay of humanized bivalent and trivalent Nanobodies IC50 value (nM)

| Nanobody | IC50 (nM) | Stand. Dev. |
|---|---|---|
| IL6R202 | 0.180 | 0.061 |
| IL6R203 | 0.056 | 0.019 |

Example 18

Antagonistic Activity in Cell-Based TF-1 Assay in Presence of Serum Albumin

To test the potential of the bivalent and trivalent Nanobodies to block the IL-6/IL6R interaction, a proliferation assay was performed using the IL-6 sensitive TF1 erythroleukemia cell line. Briefly, serial dilutions of the Nanobodies (pre-incubated with 1% serum albumin) were added to $1.25 \times 10^4$ TF-1 cells in triplicate in the presence of a fixed concentration of IL-6 (200 pg/ml). After 72 h incubation, cells were pulsed with 0.5 μCi of [$^3$H]thymidine and incubated for an additional 6 h prior to freezing at −80° C. Cells were subsequently thawed and embedded on glass fiber membranes using a cell harvester (Perkin Elmer Life Sciences, Wellesley, Mass., USA). After several washings with water, filters were air-dried and counted using a γ-counter (Perkin Elmer Life Sciences). The monoclonal antibody BR-6 known to neutralize the IL6/IL6R interaction was used as positive control. The non-neutralizing monoclonal antibody BN-12 was used as negative control. Results are summarized in the table C-25.

TABLE C-25

IC50 values of inhibition of IL-6/IL6R interaction by bivalent and trivalent anti-IL6R Nanobodies

| Compound | IC50 (w/o HSA) | IC50 (+ 1% HSA) |
|---|---|---|
| IL6R24 | 0.305 ± 0.073 (n = 4) | 0.870 ± 0.326 (n = 4) |
| IL6R44 | 0.122 ± 0.132 (n = 4) | 0.144 ± 0.052 (n = 4) |
| IL6R202 | 0.190 ± 0.056 (n = 2) | 0.6 ± 0.141 (n = 2) |
| IL6R203 | ND | 0.092 (n = 1) |
| BR6 | 0.042 ± 0.014 (n = 2) | 0.088 ± 0.036 (n = 3) |

Example 19

Binding of Anti-hIL-6R Nanobodies to Cynomolgus Monkey IL-6R Positive Cells

To verify whether the anti-human IL-6R Nanobodies are able to recognize cynomolgus IL-6R, binding to CHO-K1 cells that are stably transfected with cynomolgus IL-6R was assessed by flow cytometry.

Cell binding assays were carried out by initially incubating 200,000 cells with purified Nanobodies. After incubation, the cells were washed with FACS buffer. Cells were subsequently incubated with phycoerythrin labeled rabbit anti-$V_{HH}$ antiserum. To omit signals arising from dead cells a TOPRO-3 (Invitrogen) staining was carried out. Cells were finally analyzed on a BD FACSArray Bioanalyzer System (BD Biosciences).

FIG. 35 depicts binding of Nanobody constructs to cyno IL-6R transfected CHO-K1 cells as measured by flow cytometric analysis. It can be seen that the constructs IL6R-24, IL6R-44, IL6R-202 and IL6R-203 show clearly discernable shifts in fluorescence intensity as compared to the fluorescence intensity for cells incubated only with FACS buffer alone in the absence of any construct but with all appropriate detection agents as used for the detection of Nanobody constructs.

Example 20

Figure 36:
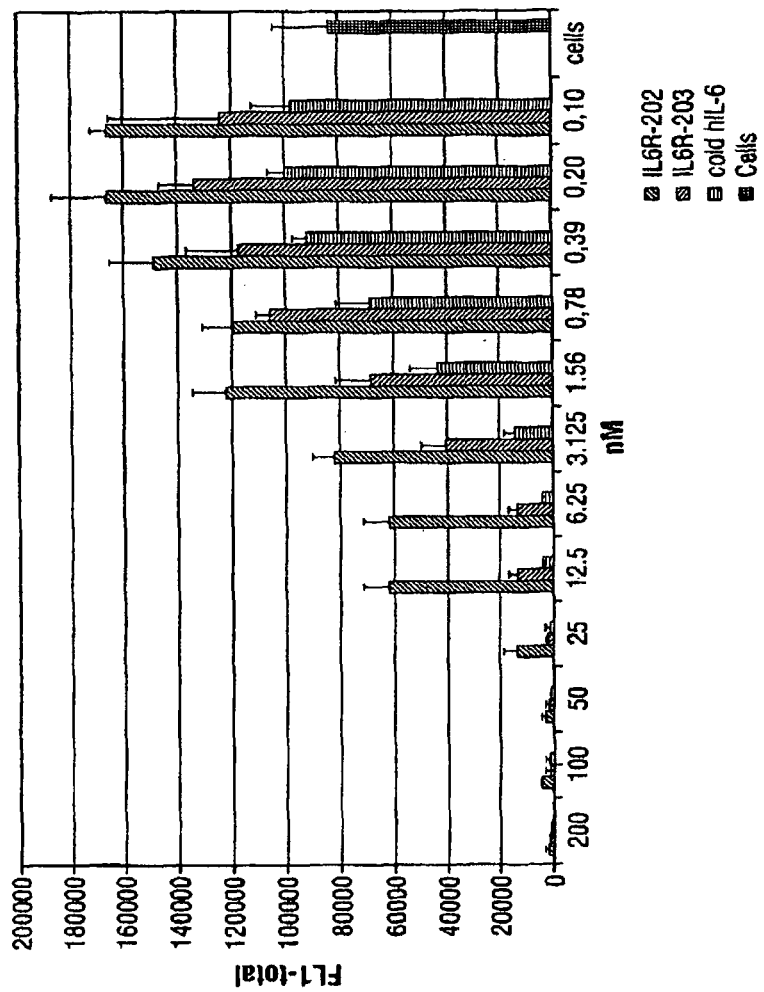
FIGS. 36 and 37 Binding inhibition curve for ALEXA[647]-labeled hIL-6 (625 pM final) competed with unlabeled hIL-6, Nanobody IL6R-202 and Nanobody IL6R-203. The average fluorescence and standard deviation is plotted against the concentration of unlabeled competitor. $IC_{50}$ values were calculated in graph pad Prism.
Figure 37:
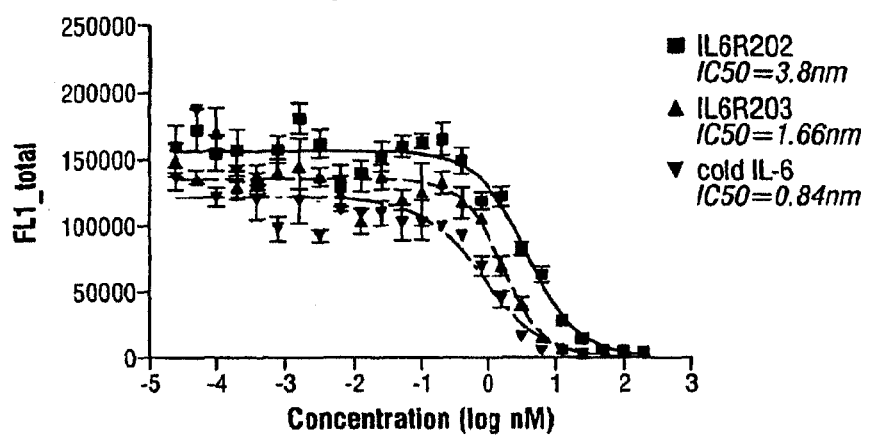

Anti-Human IL-6R Nanobodies Compete with Human IL-6 for Binding to Cynomolgus IL-6R To evaluate the capacity of expressed Nanobodies to block the binding of human IL-6 to cynomolgus IL-6R, a human IL-6 competitive homogeneous cell-based assay was performed. The FMAT 8200 HTS system (Applied Biosystems) assay was performed as follows: CHO-K1 cells stably expressing cynomolgus IL-6R were detached using 0.25% (vol/vol) trypsin and suspended in RPMI supplemented with 10% fetal calf serum (FCS), glutamine, and penicillin-streptomycin. Aliquots of 60 µl ($4\times10^3$ cells) were plated into FMAT system 384-well plates (PE Biosystems, CA) and allowed to adhere for 24 h. After overnight adherence, culture supernatant was removed by gently tapping the plate. To initiate the competitive screen, 20 µl ALEXA$^{647}$-labeled human IL-6 (625 pM final concentration) and 20 µl Nanobody or cold h-IL6 dilution were added to the cell-containing FMAT system 384-well plates (PE Biosystems, CA). The plates were scanned after 10 hours of incubation. A well was considered positive if it had a count of over 50 events. FIGS. 36 and 37 depict the results of experiments measuring the capacity of anti hIL-6R Nanobodies to block binding of hIL-6 to cynomolgus IL-6R as measured by competitive FMAT. It can be seen that the constructs IL6R-202 and IL6R-203 clearly compete with the binding of hIL-6 to cynomolgus IL-6R. The positive control cold hIL-6 shows, as expected, clearly discernable competition with ALEXA$^{647}$-labeled hIL-6.

Example 21

Construction of Anti-IL-6R Nanobody—Human Serum Albumin Fusion Proteins

HSA was constructed by gene assembly and cloned into pPICZaA as XhoI/NotI fragment.

For the generation of a NB04-HSA fusion protein, NB04 was amplified by PCR using primer pair: 5'-GGG-TATCTCTCGAGAAAAGAGAGGCT-GAAGCTGAGGTGCAG CTGGTGGAGTCTGGG-3' (SEQ ID NO: 634) and 5'-TCTCTTCTCCTAG-GTCTTTGAATCTGTGGGCGACTTCAGAT TTATGAG-CATCTGAGGAGACGGTGACCTG-3' (SEQ ID NO: 635).

The resulting PCR product was cloned into PCR4TOPO and used to clone IL6R04 N-terminally of HSA. Hereto, pPICZαA HSA and TOPO NB04-N were digested with XhoI and AvrII and ligated to each other.

To connect NB04 to the C-terminus of HSA interspaced with a linker, the following nested-PCR was performed: NB04 was first amplified by PCR using primer pair:

5'-GTGGATCCGGAGGCAGTGGAGGTTCTGGTGGGTCAGGAGGTGAG
GTGCAGCTGGTGGAGTCTGGG-3' and 5'-TAGAAAGCTGGCGGCCG
CTTATTATGAGGAGACGGTGACCTG-3'.

A second PCR was performed on the obtained product to insert a GlySer linker by use of primer pair 5'- TTGGT-TGCGGCCAGTCAGGCCGCACTTGGTTTGGGTGGAT CCGGAGGCAGTG-3' (SEQ ID NO: 638) and 5'-TAGAAAGCTGGCGGCCGCTTATTATGAGGA GACGGTGACCTG-3' (SEQ ID NO: 639).

The resulting PCR product was cloned into PCR4TOPO and used to clone NB04 at the C-terminus of HSA. Hereto, pPICZaA HSA and TOPO NB04-C were digested with NotI and SfiI and ligated to each other.

Example 22

Binding of IL6R04-HSA and HSA-IL6R04 to IL-6R-Positive Cell Lines in Flow Cytometric Analysis The test for binding to the IL-6R positive human multiple myeloma cell line U266 was carried out with purified IL6R04-HSA (SEQ ID NO 604), HSA-IL6R04 (SEQ ID NO 603) and IL6R04 (SEQ ID NO 440) using the commercially available murine anti-human IL6R antibodies BR6 and BN12 as positive controls.

Cell binding assays were carried out by initially incubating 200,000 cells with 5 nM purified Nanobody-HSA fusion proteins. After incubation, the cells were washed with FACS buffer. Cells were subsequently incubated with phycoerythrin labeled rabbit anti-$V_{HH}$ antiserum. To omit signals arising from dead cells a TOPRO-3 (Invitrogen) staining was carried out. Cells were finally analyzed on a BD FACSArray Bioanalyzer System (BD Biosciences).

Figure 38:
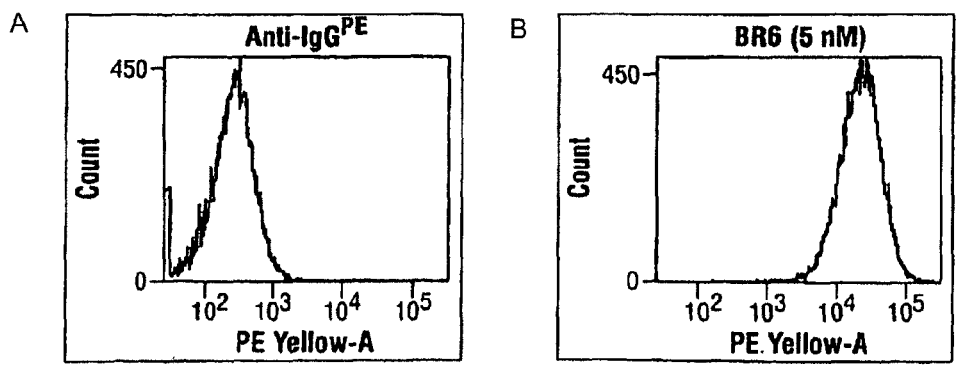

FIG. 38 depicts binding of the Nanobody-HSA fusion constructs to U266 cells as measured by flow cytometric analysis. The positive controls BR6 and BN12 show, as expected, a clearly discernable shift in fluorescence intensity as compared to the respective control (anti-IgG$^{PE}$). The constructs IL6R04-HSA and HSA-IL6R04 tested show binding to the IL6R-positive U266 cells as indicated by the shifts in fluorescence intensity as compared to the fluorescence intensity for cells incubated only with FACS buffer in the absence of any construct but with all appropriate detection agents as used for the detection of the Nanobody constructs. No obvious difference in binding to U266 cells was observed between IL6R04-HSA, HSA-IL6R04 and the monovalent IL6R04 Nanobody.

Example 23

Screening of Kinetic Off-Rate Constants via Surface Plasmon Resonance (BIAcore)

Affinity constants (Kd) of the anti-IL6R Nanobody-HSA constructs were determined by surface plasmon resonance on a Biacore 3000 instrument. In brief, IL6-R is amine-coupled to a CM5 sensor chip at a density of 800-1000 RU. Remaining reactive groups are inactivated. Nanobody binding is assessed at various concentrations ranging from 0.5 to 50 nM. Each sample is injected for 4 min at a flow rate of 45 µl/min to allow for binding to chip-bound antigen. Next, binding buffer without Nanobody is sent over the chip at the same flow rate to allow for dissociation of bound Nanobody. After 10 min, remaining bound analyte is removed by injecting regeneration solution (Glycine/HCl pH 1.5). Binding curves obtained at different concentrations of Nanobody are used to calculate Kd values. The binding characteristics are summarized in Table C-26.

TABLE C-26

Surface plasmon resonance measurements of the interaction between hIL-6R and anti-IL6R Nanobody-HSA constructs

|  | Ka (1/Ms) | Kd (1/s) | KD (nM) |
| --- | --- | --- | --- |
| IL6R04 | 5.36E+05 | 1.12E−04 | 0.20 |
| HSA-IL6R04 | 2.52E+05 | 5.62E−05 | 0.22 |
| IL6R04-HSA | 1.89E+05 | 5.60E−05 | 0.30 |

Example 24

Anti-IL6R Nanobody-Albumin Fusion can Block hIL-6 Induced Proliferation of the Erythroleukemia Cell Line TF1

To test the potential of the anti-IL6R Nanobody-albumin fusions to block the IL-6/IL6R interaction, a proliferation assay was performed using the IL-6 sensitive TF1 erythroleukemia cell line. Briefly, serial dilutions of the anti-IL6R Nanobody-albumin fusions were added to $1.25 \times 10^4$ TF-1 cells in triplicate in the presence of a fixed concentration of IL-6 (200 pg/ml). After 72 h incubation, cells were pulsed with 0.5 µCi of [$^3$H]thymidine and incubated for an additional 6 h prior to freezing at −80° C. Cells were subsequently thawed and embedded on glass fiber membranes using a cell harvester (Perkin Elmer Life Sciences, Wellesley, Mass., USA). After several washings with water, filters were air-dried and counted using a γ-counter (Perkin Elmer Life Sciences). The monoclonal antibody BR-6 known to neutralize the IL6/IL6R interaction was used as positive control. The non-neutralizing monoclonal antibody BN-12 was used as negative control.

Figure 39:
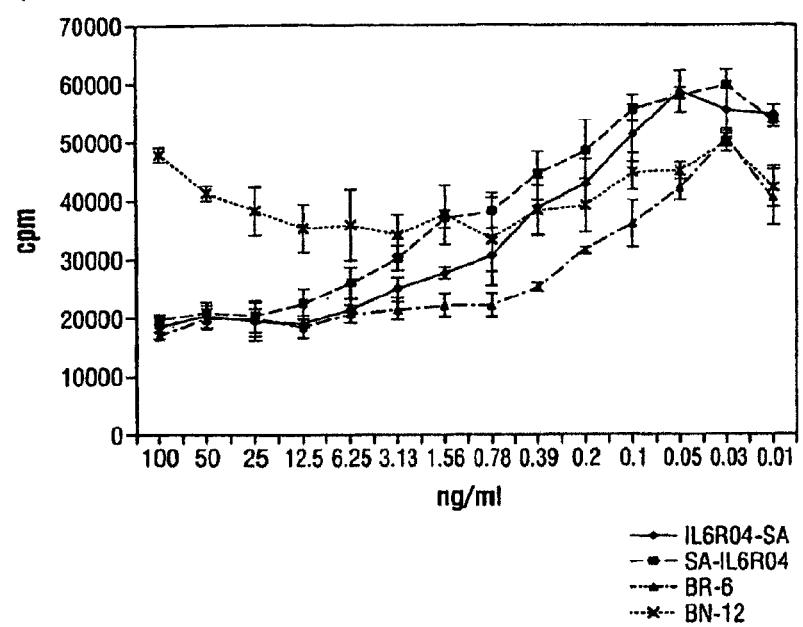
FIG. 39 Proliferative response of the TF1 cell line to Nanobody-HSA formats. $1.25 \times 10^4$ cells were seeded in triplicate in the presence of 200 pg/ml IL-6 and the indicated dilutions of Nanobody-HSA formats or control antibodies BR-6 or BN-12. The cells were pulsed with 0.5 μCi of [$^3$H]thymidine for the last 6 h of a 72-h culture period, after which the incorporated radioactivity was determined.

As shown in FIG. 39, both IL6R04-HSA and HSA-IL6R04 can efficiently block the IL-6 dependent proliferation of TF1 cells. As expected, antibody BR-6 efficiently blocked IL-6 dependent proliferation of TF1 cells whereas BN-12 had no effect.

Example 25

Generation of Multivalent Nanobody-Albumin Fusion Protein Formats

To potentially increase the biological effect of Nanobody-albumin molecules, bivalent fusions are generated whereby 2 Nanobodies are fused at the N-terminal side of serum albumin. The Nanobodies are fused head-to-tail using an amino acid linker peptide consisting of different lengths.

Here we describe the construction and characterization of bivalent Nanobody-albumin fusion proteins consisting of two identical anti-IL6-R Nanobodies separated by a 3 Ala, 9 (GS) or 20 (GS) amino acid linker peptide. DNA segments encoding Nanobody IL6R-201 were head-to-tail genetically linked and fused to human serum albumin at its N-terminal side, resulting in constructs IL6R201-HSA (SEQ ID NO 605), IL6R201-AAA-IL6R201-HSA (SEQ ID NO 608), IL6R201-9GS-IL6R201-HSA (SEQ ID NO 606), IL6R201-20GS-IL6R201-HSA (SEQ ID NO 607). All Nanobody-albumin fusion proteins were expressed in *Pichia pastoris* in shake flasks or in a fermentor. Production levels of >50 mg/l were obtained.

Example 26

Fusion of Nanobody to Albumin Increases its Serum Half-Life

The pharmacokinetic study of a HSA fusion Nanobody was conducted in Balbc mice. The mice are preferably 8 up to 12 weeks old. We tested the pharmacokinetic profile from Nanobody, IL6R04-HSA and Nanobody HSA-IL6R04. The Nanobody was injected in three mice. The mice were administrated with 200 µg/200 µl via an intravenous infusion. Blood samples were taken at 15', 1 h, 2 h, 4 h, 8 h, 24 h, day 2, day 3, day 4, day 5, day 8 and day 15 after the start of infusion. 104 l whole blood was withdrawn per sampling and the serum was isolated after 1 hr incubation at 37° C. The plasma samples are stored by −20° C.

Serum samples were tested for the determination of plasma levels of half-life extension Nanobodies.

Micro titer plates (Maxisorb) are coated with 0.5 µg/ml sIL-6R (Prepotech) in PBS at 100 µl/well overnight at 4° C. The plates are washed with PBS containing 0.1% Tween20 and blocked for 2 hours at RT with PBS containing 1% casein. Plasma samples are then diluted in a non-coated plate and incubated for 30 minutes at room temperature. 100 µl of all the dilutions is then transferred to the coated plate and allowed to bind for 1 hour at room temperature. After 1 hour, the plate is washed and 100 µl of 1/2000 dilution of biotinylated goat anti-human albumin in PBS containing 1% casein is added per well. After further incubation for half an hour at room temperature, wells are washed and 100 µl of 1/2000 dilution of streptavidin conjugated with horse radish peroxidase in PBS containing 1% casein. This enzyme catalyzes a chemical reaction with the substrate slow TMB, which results in a colorimetric change. After stopping this reaction with HCl, the intensity of the color can be measured by a spectrophotometer, which determines the optical density of the reaction product, using a 450 nm wavelength of light.

The half-life extension Nanobody concentration in the plasma samples is determined towards a standard curve. The concentration determination is determined with the sigmoidal dose-response curve with variable slope.

Figure 40:
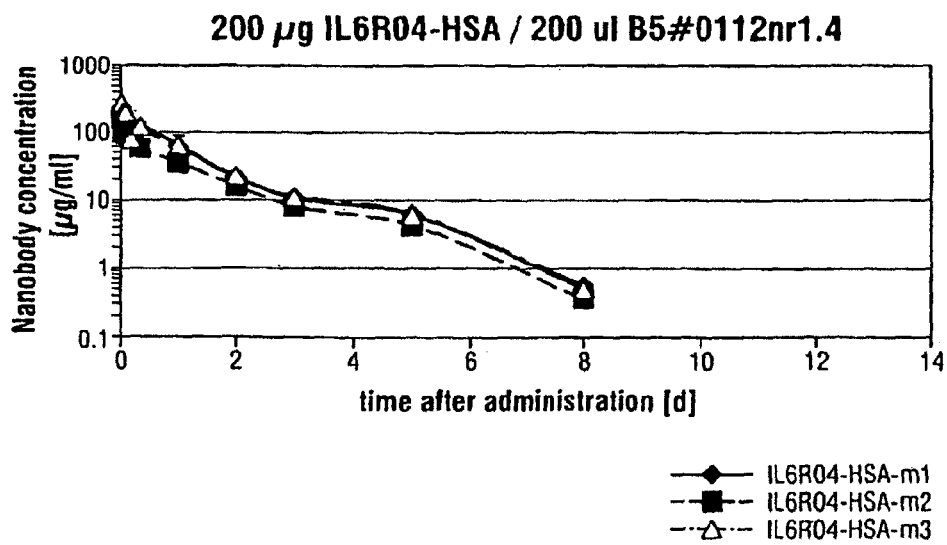
FIG. 40 PK analysis of Nanobody IL-6R04-HSA in Balb/c mice. The mean half-life of Nanobody IL-6R04-HSA is 1.10 days.

FIG. 40 shows that the albumin fusion prolonges the half-life of a monovalent Nanobody targeting IL6R (IL6R-HSA) and has been determined to be 1.10 days.

The half-life for HSA-IL6R04 has been determined to be 1.0 days.

As a non-formatted Nanobody is cleared within the first hour, the increase in half-life by fusing with human albumin is more than 25 fold.

Example 27

Pharmacokinetic Profile in Cynomolgus Monkey

A pharmacokinetic study of IL6R202, IL6R203 and IL6R04HSA was conducted in cynomolgus monkeys. The Nanobody was administered intravenously by bolus injection (1.0 ml/kg, approximately 30 sec) in the vena cephalica of the left or right arm to obtain a dose of 2.0 mg/kg. Table C-27 summarizes the dosing regimen for all monkeys.

TABLE C-27

Dosing regimen of all animals

| Group | Test item | Route | Animal | Animal ID | Dose Volume (ml/kg) | Dose (mg/kg) |
|---|---|---|---|---|---|---|
| 1 | IL6R04-HSA | Iv (bolus) | Cynomolgus Monkey | 1 m | 1.0 | 2.0 |
|   |   | Iv (bolus) | Cynomolgus Monkey | 2 f | 1.0 | 2.0 |
| 2 | IL6R202 | Iv (bolus) | Cynomolgus Monkey | 3 m | 1.0 | 2.0 |
|   |   | Iv (bolus) | Cynomolgus Monkey | 4 f | 1.0 | 2.0 |

TABLE C-27-continued

Dosing regimen of all animals

| Group | Test item | Route | Animal | Animal ID | Dose Volume (ml/kg) | Dose (mg/kg) |
|---|---|---|---|---|---|---|
| 3 | IL6R203 | Iv (bolus) | Cynomolgus Monkey | 5 m | 1.0 | 2.0 |
|  |  | Iv (bolus) | Cynomolgus Monkey | 6 f | 1.0 | 2.0 |

The anti-IL6R Nanobody concentration in the plasma samples was determined as follows:

a) Immunodetection of IL6R04-HSA in Plasma Samples

Maxisorb micro titer plates (Nunc, Article No. 430341) were coated overnight at 4° C. with 100 µl of a 0.5 µg/ml solution of sIL6R (Peprotech, Article No. 20006R) in DPBS (pH 7.4). After coating, the plates were washed three times (PBS containing 0.1% Tween20) and blocked for 2 hours at room temperature (RT) with PBS containing 1% casein (250 µl/well). Plasma samples and serial dilutions of Nanobody-standards (spiked in 100% pooled blank cynomolgus plasma) were diluted in PBS (in a separate non-coated plate) to obtain the desired concentration/dilution in a final sample matrix consisting of 10% pooled cynomolgus plasma in PBS. All pre-dilutions were incubated for 30 minutes at RT in the non-coated plate. After the blocking step, plates were washed three times (PBS containing 0.1% Tween20), and an aliquot of each sample dilution (100 µl) was transferred to the coated plates and allowed to bind for 1 hour at RT. After sample incubation, the plates were washed three times (PBS containing 0.1% Tween20) and incubated with 100 µl of 1/2000 dilution (in PBS containing 0.1% casein) of polyclonal goat anti-human serum albumin (Nordic Immunology, Article No. 5184). After 1 hour at RT, the plates were washed three times (PBS containing 0.1% Tween20) and incubated with 100 µl of a 1/2000 dilution (in PBS containing 1% casein) of streptavidine conjugated with horseradish peroxidase (DaktoCytomation, Article No. P0397). After 30 minutes, plates were washed three times (PBS containing 0.1% Tween20) and incubated with 100 µl of slow TMB (Pierce, Article No. 34024). After 20 minutes, the reaction was stopped with 100 µl HCl (1N). The absorbance of each well was measured at 450 nm (Tecan Sunrise spectrophotometer), and corrected for absorbance at 620 nm. This assay measures free and sIL6R-bound IL6R04-HSA Nanobodies. Concentration in each plasma sample was determined based on a sigmoidal standard curve with variable slope of the respective Nanobody. The LLOQ and ULOQ of IL6R04-HSA were 2.00 ng/ml and 100 ng/ml, respectively. Each individual plasma sample was analyzed in three independent assays and an average plasma concentration was calculated for pharmacokinetic data analysis.

b) Immunodetection of IL6R202 and IL6R203 in Plasma Samples

Maxisorb micro titer plates (Nunc, Article No. 430341) were coated overnight at 4° C. with 100 µl of a 5 µg/ml solution of 12B2-GS9-12B2 (B2#1302nr4.3.9) in bicarbonate buffer (50 mM, pH 9.6). After coating, the plates were washed three times with PBS containing 0.1% Tween20 and blocked for 2 hours at room temperature (RT) with PBS containing 1% casein (250 µl/well). Plasma samples and serial dilutions of Nanobody-standards (spiked in 100% pooled blank cynomolgus plasma) were diluted in PBS in a separate non-coated plate (Nunc, Article No. 249944) to obtain the desired concentration/dilution in a final sample matrix consisting of 10% pooled cynomolgus plasma in PBS. All pre-dilutions were incubated for 30 minutes at RT in the non-coated plate. After the blocking step, the coated plates were washed three times (PBS containing 0.1% Tween20), and an aliquot of each sample dilution (100 µl) was transferred to the coated plates and allowed to bind for 1 hour at RT. After sample incubation, the plates were washed three times (PBS containing 0.1% Tween20) and incubated for 1 hour at RT with 100 µl of a 100 ng/ml solution of sIL6R in PBS (Peprotech, Article No. 20006R). After 1 hour at RT, the plates were washed three times (PBS containing 0.1% Tween20) and incubated with 100 µl of a 250 ng/ml solution of a biotinylated polyclonal anti-IL6R antibody in PBS containing 1% casein (R&D systems, Article No. BAF227). After incubation for 30 minutes (RT), plates were washed three times (PBS containing 0.1% Tween20) and incubated for 30 minutes (RT) with 100 µl of a 1/5000 dilution (in PBS containing 1% casein) of streptavidine conjugated with horseradish peroxidase (DaktoCytomation, Article No. P0397). After 30 minutes, plates were washed three times (PBS containing 0.1% Tween20) and incubated with 100 µl of slow TMB (Pierce, Article No. 34024). After 20 minutes, the reaction was stopped with 100 µl HCl (1N). The absorbance of each well was measured at 450 nm (Tecan Sunrise spectrophotometer), and corrected for absorbance at 620 nm. This assay measures free Nanobody as well as Nanobodies bound to sIL6R and/or cynomolgus serum albumin. Concentration in each plasma sample was determined based on a sigmoidal standard curve with variable slope of the respective Nanobody. The LLOQ and ULOQ of IL6R202 were 7.00 ng/ml and 300 ng/ml, respectively. The LLOQ and ULOQ of IL6R203 were 2.00 ng/ml and 70.0 ng/ml, respectively.

Each individual plasma sample was analyzed in two independent assays and an average plasma concentration was calculated for pharmacokinetic data analysis.

Figure 41:
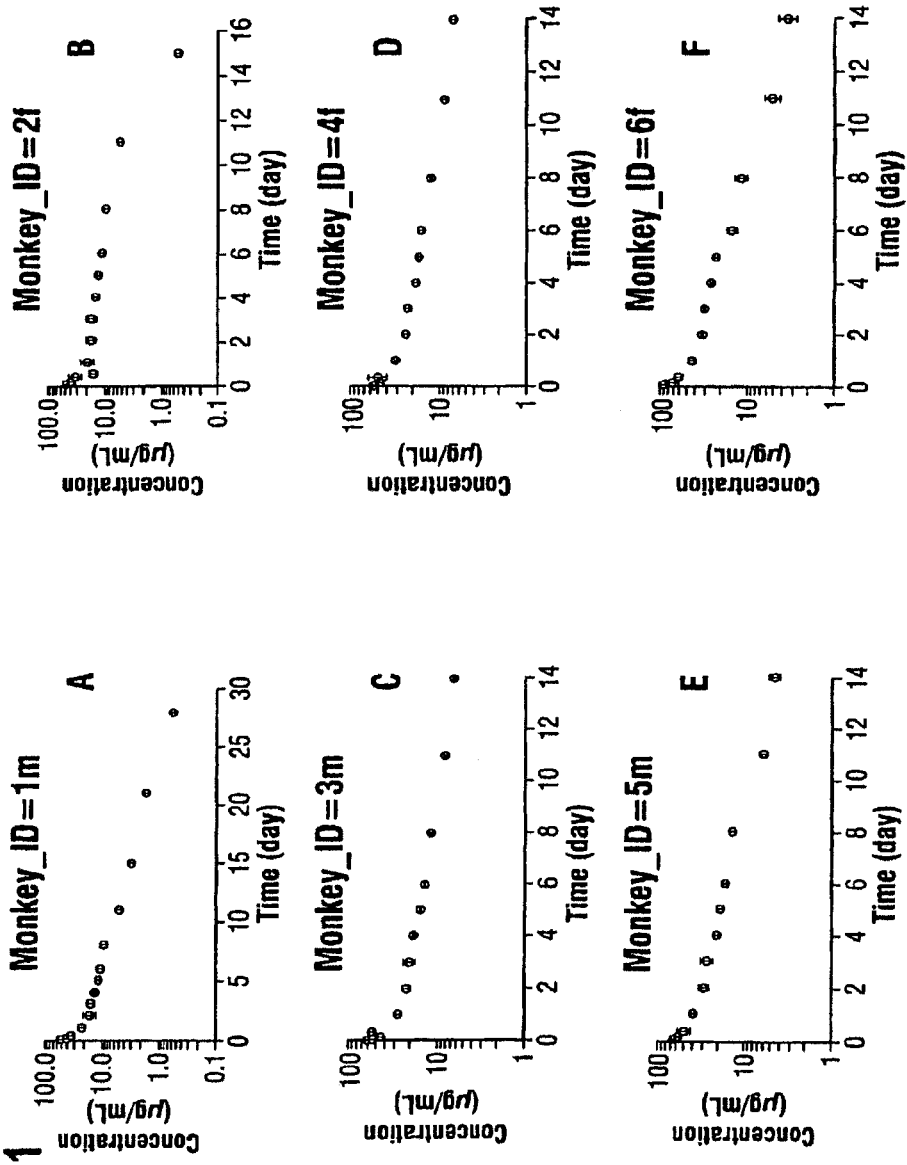
FIG. 41 Mean observed (±SD) plasma concentration-time profiles after intravenous administration of 2.00 mg/kg of (A, B) IL6R04-HSA, (C,D) IL6R202 and (E,F) IL6R203.

Mean observed plasma concentration-time profiles (±SD) after intravenous administration of IL6R04-HSA (2.0 mg/kg), IL6R202 or IL6R203 are shown in FIG. 41.

Basic pharmacokinetic parameters of IL6R04-HSA, IL6R202 and IL6R203 after a single intravenous administration at 2.00 mg/kg in the male and female cynomolgus monkey are listed in Tables C-28, C-29 and C-30, respectively. All parameters were calculated with two-compartmental modeling, with elimination from the central compartment.

TABLE C-28

Basic pharmacokinetic parameters[1] of IL6R04-HSA after a single intravenous administration at 2.00 mg/kg in the male and female Cynomolgus Monkey.

| | Monkey 1 m | Monkey 2 f[2] | Mean SD | CV(%) |
|---|---|---|---|---|
| $C_{(0)}$ (μg/ml) | 50.6 | 49.0 | 49.8 ± 1.13 | 2.27 |
| $V_{ss}$ (mL/kg) | 79.1 | 77.2 | 78.2 ± 1.34 | 1.72 |
| $V_z$ (mL/kg) | 84.4 | 80.8 | 82.6 ± 2.55 | 3.08 |
| $V_c$ (mL/kg) | 39.6 | 40.8 | 40.2 ± 0.849 | 2.11 |
| $V_t$ (mL/kg) | 39.5 | 36.4 | 38.0 ± 2.19 | 5.78 |
| CL (mL/day/kg) | 10.3 | 10.5 | 10.4 ± 0.141 | 1.36 |
| $CL_d$ (mL/day/kg) | 41.6 | 55.7 | 48.7 ± 9.97 | 20.5 |
| $t_{1/2\alpha}$ (day) | 0.309 | 0.229 | 0.269 ± 0.0566 | 21.0 |
| $t_{1/2\beta}$ (day) | 5.69 | 5.33 | 5.51 ± 0.255 | 4.62 |
| MRT (day) | 7.70 | 7.37 | 7.54 0.233 | 3.10 |
| $AUC_{inf}$ (μg · day/ml) | 194 | 191 | 193 ± 2.12 | 1.10 |
| $AUC_{inf}/D$ (kg · day/ml) | 0.0970 | 0.0955 | 0.0963 ± 0.00106 | 1.10 |

[1]All parameters were calculated with two-compartmental modeling
[2]Estimate of PK parameters should be interpreted with caution because the method of calculation ignores the immunological clearance due to neutralizing antibodies.

TABLE C-29

Basic pharmacokinetic parameters[1] of IL6R202 after a single intravenous administration at 2.00 mg/kg in the male and female Cynomolgus Monkey.

| | Monkey 3 m | Monkey 4 f | Mean SD | CV(%) |
|---|---|---|---|---|
| $C_{(0)}$ (μg/ml) | 57.6 | 56.5 | 57.1 ± 0.778 | 1.36 |
| $V_{ss}$ (mL/kg) | 65.1 | 60.6 | 62.9 ± 3.18 | 5.06 |
| $V_z$ (mL/kg) | 70.0 | 64.6 | 67.3 ± 3.82 | 5.67 |
| $V_c$ (mL/kg) | 34.7 | 35.4 | 35.1 ± 0.495 | 1.41 |
| $V_t$ (mL/kg) | 30.4 | 25.2 | 27.8 ± 3.68 | 13.2 |
| CL (mL/day/kg) | 6.97 | 6.74 | 6.86 ± 0.163 | 2.37 |
| $CL_d$ (mL/day/kg) | 22.1 | 19.1 | 20.6 ± 2.12 | 10.3 |
| $t_{1/2\alpha}$ (day) | 0.474 | 0.500 | 0.487 ± 0.0184 | 3.78 |
| $t_{1/2\beta}$ (day) | 6.96 | 6.64 | 6.80 ± 0.226 | 3.33 |
| MRT (day) | 9.35 | 8.99 | 9.17 0.255 | 2.78 |
| $AUC_{inf}$ (μg · day/ml) | 287 | 297 | 292 ± 7.07 | 2.42 |
| $AUC_{inf}/D$ (kg · day/ml) | 0.144 | 0.148 | 0.146 ± 0.00283 | 1.94 |

[1]All parameters were calculated with two-compartmental modeling

TABLE C-30

Basic pharmacokinetic parameters of IL6R203 after a single intravenous administration at 2.00 mg/kg in the male and female Cynomolgus Monkey.

| | Monkey 5 m | Monkey 6 f | Mean SD | CV(%) |
|---|---|---|---|---|
| $C_{(0)}$ (μg/ml) | 67.1 | 87.8 | 77.5 ± 14.6 | 18.9 |
| $V_{ss}$ (mL/kg) | 41.5 | 34.1 | 37.8 ± 5.23 | 13.8 |
| $V_z$ (mL/kg) | 42.5 | 35.2 | 38.9 ± 5.16 | 13.3 |
| $V_c$ (mL/kg) | 29.8 | 22.8 | 26.3 ± 4.95 | 18.8 |
| $V_t$ (mL/kg) | 11.7 | 11.3 | 11.5 ± 0.283 | 2.46 |
| CL (mL/day/kg) | 6.98 | 7.11 | 7.05 ± 0.0919 | 1.30 |
| $CL_d$ (mL/day/kg) | 22.7 | 27.2 | 25.0 ± 3.18 | 12.8 |
| $t_{1/2\alpha}$ (day) | 0.250 | 0.187 | 0.219 ± 0.0445 | 20.4 |
| $t_{1/2\beta}$ (day) | 4.22 | 3.43 | 3.83 ± 0.559 | 14.6 |
| MRT (day) | 5.94 | 4.80 | 5.37 0.806 | 15.0 |
| $AUC_{inf}$ (μg · day/ml) | 286 | 281 | 284 ± 3.54 | 1.25 |
| $AUC_{inf}/D$ (kg · day/ml) | 0.143 | 0.141 | 0.142 ± 0.00141 | 1.00 |

[1]All parameters were calculated with two-compartmental modeling

Example 28

Efficacy in Cynomolgus Monkey

In human and non-human primates, human IL-6 (hIL-6) has been reported to induce acute phase protein synthesis (Gauldi et al, 1987; Asano et al., 1990). Acute phase proteins are defined as a set of plasma proteins, like C-reactive protein (CRP), serum amyloid A, haptoglobin, fibrinogen, albumin, transferrin and C3, increasing or decreasing concentrations by at least 25% in inflammatory disorders, mainly due to changes in their production by hepatocytes (Gabay & Kushner, 1999). Patterns of cytokine production and acute phase response differ in different inflammatory conditions. Therefore, acute phase changes reflect the presence and intensity of inflammation, making them diagnostically relevant.

In this study, the ability of IL6R202 and IL6R203 to block in vivo IL-6 induced responses was examined in primates.

Adult cynomolgus monkeys (*Macaca fascicularis*), aged between 3 and 4 years and weighing below 3 kg were housed individually in an environment controlled room, at room temperature. The body weight of all individuals was recorded at first administration and weekly from there on. The animals were numbered and coupled in groups of 2 individuals (one male and one female) with approximately equal mean body weight.

The lyophilized hIL-6 (Gentaur) was dissolved in 0.5 M acetic acid to a final concentration of 100 µg/mL. One vial containing 500 µs IL-6 was dissolved in 5 mL 0.5 M acetic acid. First, 3 ml, of 0.5 M acetic acid was added to the vial and the solution was swirled until all lyophilisate was dissolved. The solution was transferred to a sterile polystyrene tube. The vial was rinsed with 2 mL of 0.5 M acetic acid and this solution was transferred to the polystyrene tube as well, with subsequent gentle mixing of the solution.

Human IL-6 was administered via an s.c. bolus injection of 1 mL/kg b.w. in 1% autologues Cynomolgus monkey heat inactivated serum in the dorsal region.

8 groups (group 4 to 11, Table C-31) of animals received a single i.v. injection of IL6R202 or IL6R203, in one of four different dosages; namely 0.6, 2, 6 or 20 mg/kg b.w. in D-PBS. The Nanobodies® were administered via an i.v. bolus injection of 1 mL/kg b.w. in D-PBS into the vena cephalica of the left or right arm. Subsequently after 1 hour, all animals were injected with the first of 7 daily injections s.c. of hIL-6 (5 µg/kg b.w.). Two individuals of one group (group 12, 23m and 24f, Table C-31) received no Nanobody® preadministration and served as a negative control.

Blood samples were collected prior to injection on test day 0 and from there on daily from test day 1 to test clay 14 and on day 21.

The inflammation parameter CRP (serum C-reactive protein levels) is one of the most important parameters for evaluating efficacy with respect to acute phase response in this animal model (animal model that was used in the current study is described in detail in Asano et al. (1990) Blood 8, 1602-1605). Furthermore, CRP is also one of the most important non-subjective parameters used in evaluating efficacy of anti-inflammatory response compounds in human subjects as part of clinical trials, which is well documented in the following references: Choy et al. (2002) Arthritis and Rheumatism 46 (12) 3143-50; Nishimoto et al. (2004) Arthritis and Rheumatism 50 (6) 1761-69; Maini et al. (2006) Arthritis and Rheumatism 54 (9) 2817-29. An increase in the levels of CRP is one of the most relevant indications of inflammation.

In the current animal model, the CRP levels and a number of other parameters were measured (results for the latter not shown); the inflammation parameter ESR (erythrocyte sedimentation rate) could not be determined in a quantitative manner (i.e. to provide a dose-response curve) using this model.

TABLE C-31

Chronologic schedule of hIL-6 and test item administration

| Animal group | Animal number | | Nanobody ® | | | hIL6 | |
|---|---|---|---|---|---|---|---|
| | Male | Female | Test item | Admin (day) | dose | Admin (day) | dose |
| 4 | 7 | 8 | IL6R202 | 1 | 0.6 mg/kg b.w. | 1, 2, 3, 4, 5, 6, 7 | 5 µg/kg b.w. |
| 5 | 9 | 10 | IL6R202 | 1 | 2 mg/kg b.w. | 1, 2, 3, 4, 5, 6, 7 | 5 µg/kg b.w. |
| 6 | 11 | 12 | IL6R202 | 1 | 6 mg/kg b.w. | 1, 2, 3, 4, 5, 6, 7 | 5 µg/kg b.w. |
| 7 | 13 | 14 | IL6R202 | 1 | 20 mg/kg b.w. | 1, 2, 3, 4, 5, 6, 7 | 5 µg/kg b.w. |
| 8 | 15 | 16 | IL6R203 | 1 | 0.6 mg/kg b.w. | 1, 2, 3, 4, 5, 6, 7 | 5 µg/kg b.w. |
| 9 | 17 | 18 | IL6R203 | 1 | 2 mg/kg b.w. | 1, 2, 3, 4, 5, 6, 7 | 5 µg/kg b.w. |
| 10 | 19 | 20 | IL6R203 | 1 | 6 mg/kg b.w. | 1, 2, 3, 4, 5, 6, 7 | 5 µg/kg b.w. |
| 11 | 21 | 22 | IL6R203 | 1 | 20 mg/kg b.w. | 1, 2, 3, 4, 5, 6, 7 | 5 µg/kg b.w. |
| 12 | 23 | 24 | — | — | — | 1, 2, 3, 4, 5, 6, 7 | 5 µg/kg b.w. |

Figure 42:
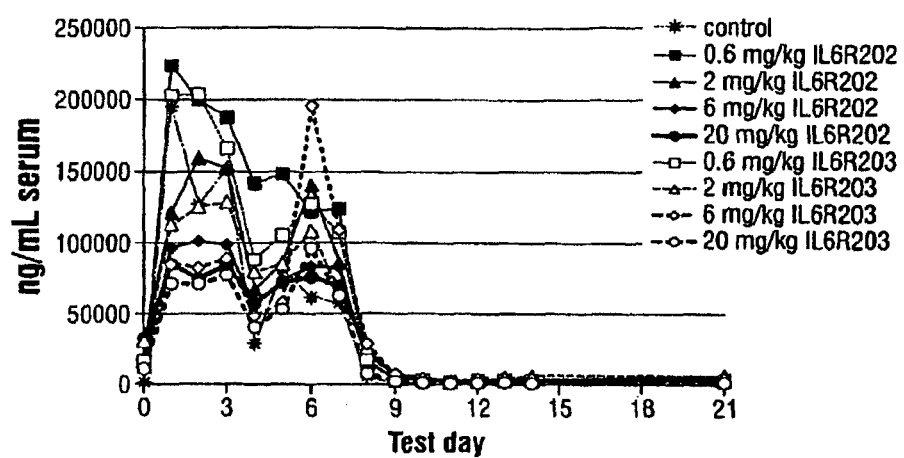
FIG. 42 The level of CRP in cynomolgus monkey for the evaluation of in vivo efficacy of anti-IL6R Nanobodies FIGS. 43, 44 and 45 Analysis of epitope specificity of a panel of Nanobodies in comparison with the Reference-Fab and Reference IgG (see Reference Example 1 and SEQ ID NOs: 629 to 632) using ELISA FIG. 46 Evaluation of specificity of a panel of Nanobodies in comparison with the Reference-Fab (see example 29, first paragraph) using Biacore FIGS. 47, 48, 49 and 50 (Panel A-B) Potency of anti IL6R Nanobodies to inhibit the binding of human IL6 to human, rhesus and cynomolgus monkey soluble IL6R present in plasma

Data on the level of CRP are presented in FIG. 42. At test day 2, the serum concentration of CRP in all groups, control and test, reached a maximum of up to 13 times the base level. A clear correlation between the administered dosage of either Nanobody® and the level of increase in CRP was observed.

Example 29

Competition ELISA with Reference IgG

To analyze epitope specificity of a panel of Nanobodies in comparison with the Reference IgG, an ELISA experiment was designed where the Reference IgG MRA was coated, and a dilution series of Nanobodies pre-incubated with a constant amount of IL6R was subsequently transferred to the wells.

Detection was performed using biotinylated anti-IL6R Mab M182 (Pharmingen) and streptavidin-HRP. Data indicate that only for Reference Fab, IL6R-03, IL6R65, IL6R13 and IL6R88a competitive binding to the Reference IgG was observed.

Figure 43:
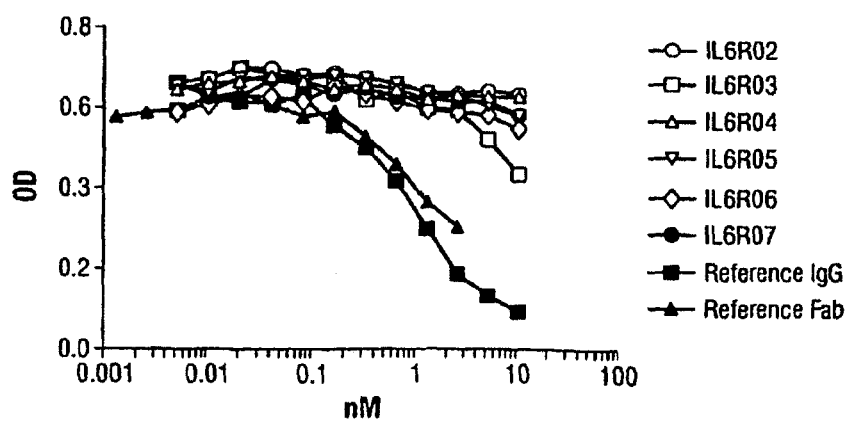
Figure 44:
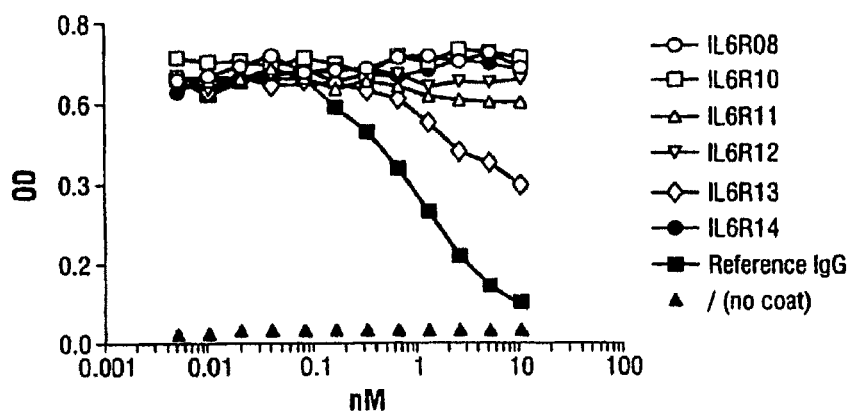
Figure 45:
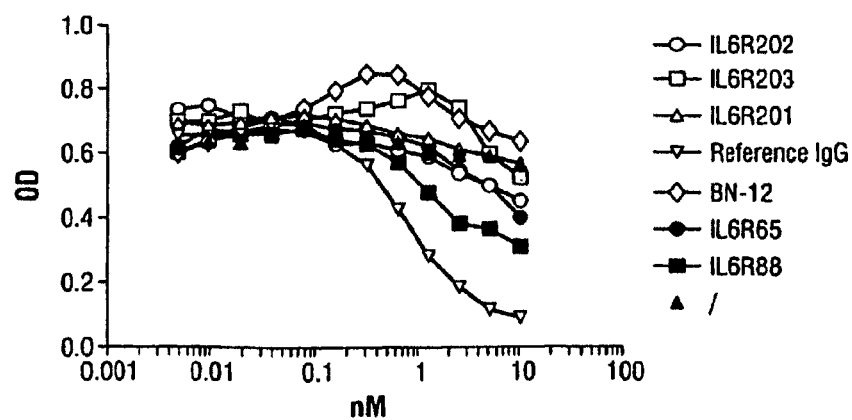

Data are presented in FIGS. 43, 44 and 45.

Example 30

Biacore Reference-Fab

To analyze epitope specificity of a panel of Nanobodies in comparison with the Reference-Fab, a Biacore experiment was designed where BN12, a non-neutralizing anti-human IL6R Mab (Diaclone) was coupled to the chip in Sodium acetate pH=4. Next, 100 nM IL-6R was injected on the chip. Then, 100 nM of an anti-IL-6R nanobody was injected. Finally, a mixture of 100 nM Reference-Fab and 100 nM Nanobody was injected.

Figure 46:
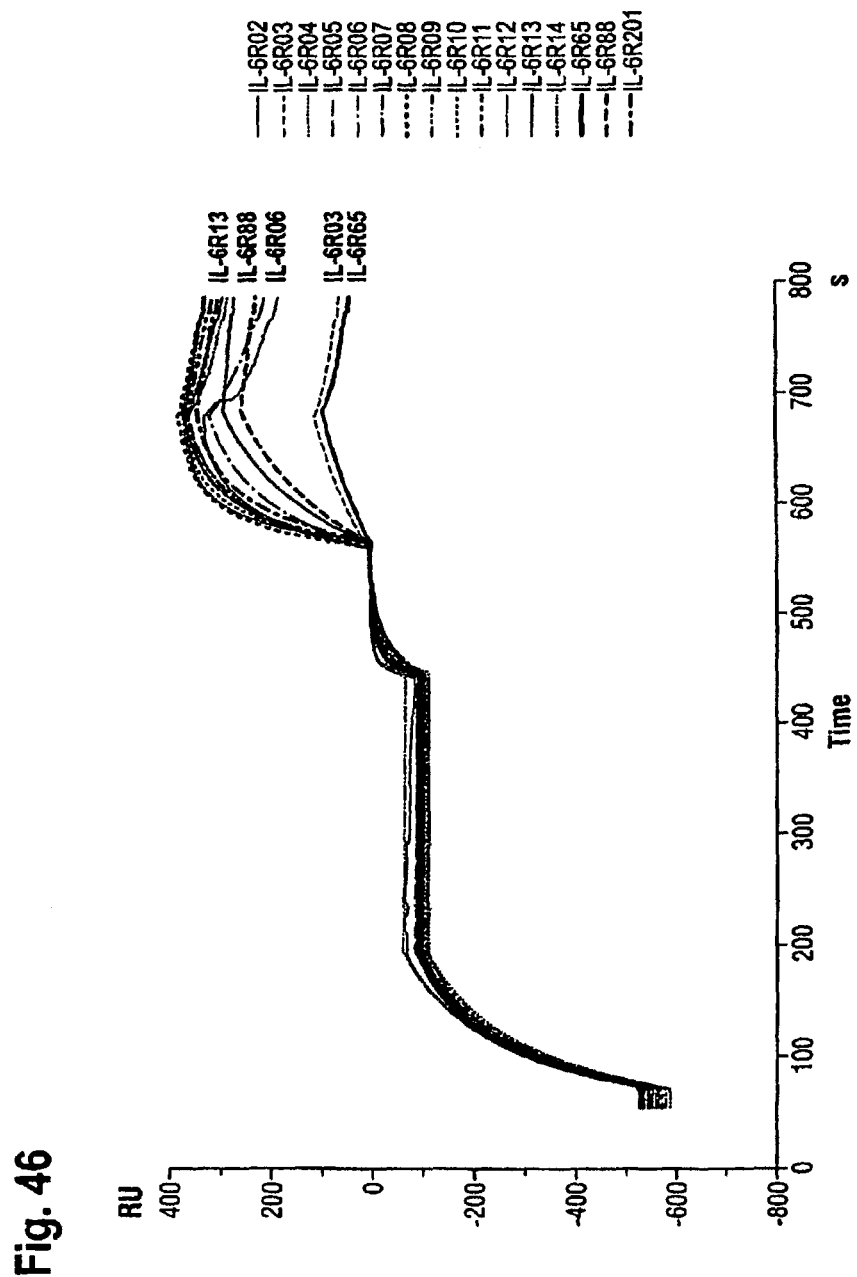
Figure 47:
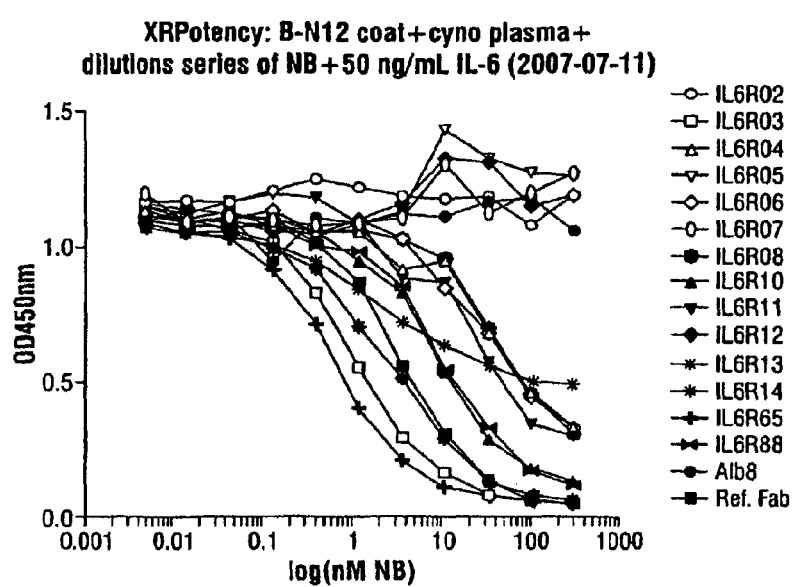
Figure 48:
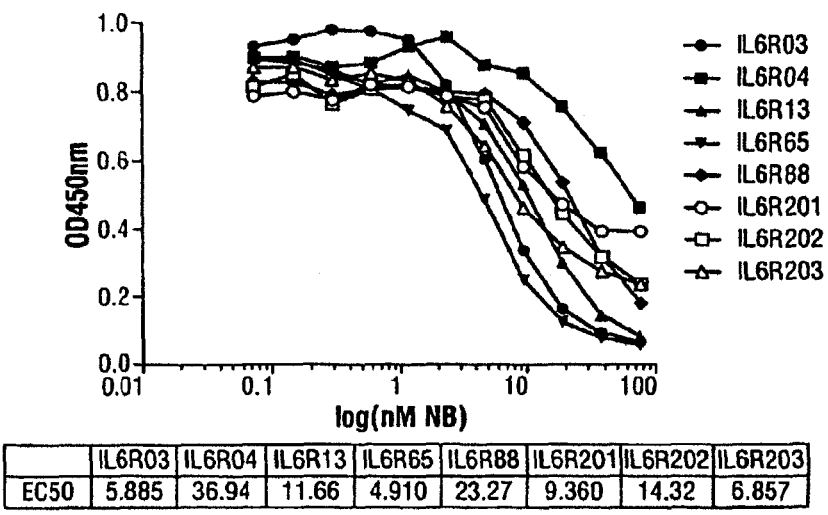
Figure 49:
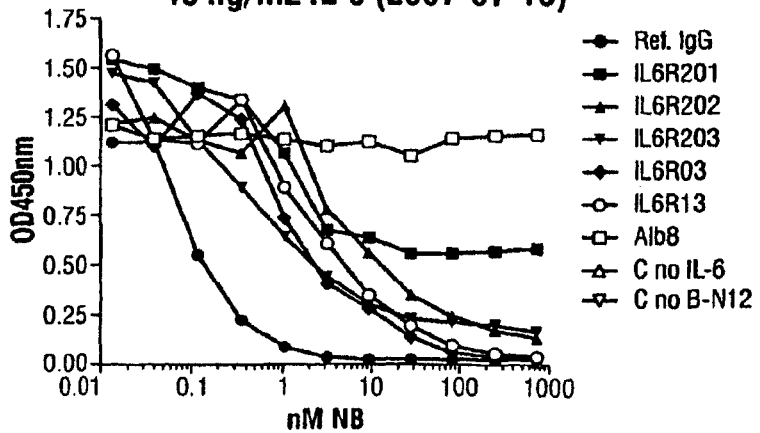

Results (FIG. 46) showed that, for all Nanobodies tested, the Reference-Fab was still binding to IL-6R when IL-6R was already bound by the Nanobodies. This indicated that the anti-IL-6R Nanobodies possibly recognized a different epitope on IL-6R. Only for Nanobodies IL6R-03, IL6R65, IL6R06, IL6R13 and IL6R88a reduced binding was observed.

Example 31

Potency to Inhibit Binding of Human IL6 to Human, Rhesus and Cynomolgus Monkey Soluble IL6R from Plasma Potency to inhibit the binding of human IL6 to human, rhesus and cynomolgus monkey soluble IL6R present in plasma was analyzed for a panel of Nanobodies. A non-neutralizing anti-IL6R Mab BN12 (Diaclone) was coated on a microtiter well plate. Subsequently, plasma from human, rhesus or cynomolgus monkey pre-incubated with human IL6 and a dilution series of Nanobody was applied to the plate.

Detection was performed using anti-IL6-biotine followed by streptavidin-HRP reagent. Data are presented in FIGS. 47, 48, 49 and 50.

Reference Example 1

Preparation of Reference Fab and IgG According to EP 0 628 639 (=WO 92/19759)

Two representative anti-human IL-6R immunoglobulins according to EP 0 628 639 (a Fab fragment and a full-sized IgG) were generated and used as reference compounds herein.

The Fab fragment and full-sized IgG were constructed based on the L-chain called "$RV_L a$" (see EP 0 628 639 B1, Table 2, version (a)) and the H-chain called "$RV_H f$" (see EP 0 628 639 B1, Table 3, version (f)). These particular L-chain and H-chain were chosen for the purposes of constructing the reference compounds because, according to EP 0 268 639 B1 (see for example paragraph [0074]), a reshaped human antibody comprising said L-chain and said H-chain exhibited an ability to bind to human IL-6R at the same level as PM1, a mouse monoclonal antibody against human IL-6R (see again EP 0 628 639 B1, paragraph [009] and the further references cited therein).

The full-length reference IgG consisted of the amino acid sequences of SEQ ID NO: 629 (heavy chain) and SEQ ID NO: 630 (light chain). The Fab fragment consisted of the amino acid sequences of SEQ ID NO: 631 (heavy chain regions $V_L b$ and $V_H f$ fused to the CH1 region of human IgG1) and SEQ ID NO: 632 (reshaped human PM-1 variable light chain fused to human Ckappa).

Encoding DNA fragments were generated by assembly PCR using partially overlapping oligonucleotides. PCR products were cloned into a single, bi-cistronic vector which enables expression of functional, disulphide-linked Fab fragments in the periplasm of *E. coli*. Full-length IgG was produced in CHO cells transfected with 2 expression vectors containing the genes for the light and heavy chains. The gene encoding the heavy chain was created by fusing $V_H f$ to the constant region of human IgG1. The light chain was as described in EP 0 268 639.

TABLE B-1

Nanobodies and polypeptides against the IL-6 receptor.

Nanobodies against the IL-6 receptor

```
<  > PMP40C9(t), SEQ ID NO: 399; PRT; ->
EVQLVESGGGLVQPGGSLRLSCAASGFSLDYYAIGWFRQAPGKEREGVSCM
DSSAGTTSTYYSDSVKGRFTISRDDAKNTVYLQMNSLKPEDTAVYYCAADGHLNW
GQRYVPCSQISWRGWNDYWGQGTQVTVSS

<  > PMP34F8(t), SEQ ID NO: 400; PRT; ->
EVQLVESGGGLVQPGGSLRLSCAASGFSLDYYAIGWFRQAPGKEREGVSCM
DSSDGTTNTYYSDSVKGRFTISRDDAKNTVYLQMNSLKPEDTASYYCAADGHLNW
GQPYVPCSQISWRGWNDYWGQGTQVTVSS

<  > PMP34E9(t), SEQ ID NO: 401; PRT; ->
EVQLVESGGGLVQPGGSLRLSCAASGFTLDYYAIGWFRQAPGKEREGVSCISS
SDGSTYYADSVKGRFTISRDNAKNTVYLQMNSLKPEDTAAYYCATDRSVYYCSGDA
PEEYYWGQGTQVTVSS

<  > PMP34D2(t), SEQ ID NO: 402; PRT; ->
EVQLVESGGGLVQPGGSLRLSCAASGFTLDYFAIGWFRQAPGKERERVSCISS
SDGSTYYADSVKGRFTISRDNAKNTVYLQMNSLKPEDTAVYYCATDRSVYYCSGGA
PEEYYWGQGTQVTVSS

<  > PMP34C3(t), SEQ ID NO: 403; PRT; ->
EVQLVESGGGLVQPGGSLRLSCVASGFSLDYYVIGWFRQAPGKEREGVSCISS
SDGSTYYADSVKGRFTISRDNAKNTVYLQMNSLKPEDTAVYYCAADLLRTPEFCVD
SAPYDYWGRGTQVTVSS
```

TABLE B-1-continued

Nanobodies and polypeptides against the IL-6 receptor.

< > PMP34A5(t), SEQ ID NO: 404; PRT; ->
EVQLVESGGGLVQPGGSLRLSCAASGFTLGYFAIGWFRQAPGKEREGVSCISS
SDGSTYYADSVKGRFTVSRDNAKNTVYLQMNSLKPEDTAVYYCATDRSVYYCSGG
APEEYYWGQGTQVTVSS

< > PMP33G3(t), SEQ ID NO: 405; PRT; ->
EVQLVESGGGLVQPGGSLRLSCAASGFTLGYFAIGWFRQAPGKEREGVSCISS
SDGSAYYADSVKGRFTVSRDNAKNTVYLQMNSLKPEDTAVYYCATDRSVYYCSGG
APEEYYWGQGTQVTVSS

< > PMP33C10(t), SEQ ID NO: 406; PRT; ->
EVQLVESGGGLVQPGGSLRLSCAASGFTFDDYGMSWVRQAPGKGLEWVSAI
SWNGGSTYYTESMKGRFTISRDNAKNTVYLQMNSLKPEDTAVYYCVKGSTAIVGVP
PTYPDEYDYWGQGTQVTVSS

< > PMP33A2(t), SEQ ID NO: 407; PRT; ->
EVQLVESGGGLVQPGGSLRLSCAASGFSLDYYAIGWFRQAPGKEREGVSCM
DSSGGTTSTYYSDSVKGRFTISRDDAKNTVYLQMNSLKPEDTAVYYCAADGHLNW
GQRYVPCSQISWRGWNDYWGQGTQVTVSS

< > PMP32H5(t), SEQ ID NO: 408; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP32F10(t), SEQ ID NO: 409; PRT; ->
EVQLVESGGGLVQAGGSLRLSCAASGFTFDDYAIGWFRQAPGKEREGISCISS
SDGSTYYADSVKGRFTISSDNAKNTVYLQMNSLKPEDTAVYYCAAEPPDSSWILDGS
PEFFKFWGQGTQVTVSS

< > PMP31F4(t), SEQ ID NO: 410; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP31D2(t), SEQ ID NO: 411; PRT; ->
EVQLVESGGGLVQAGGSLRLSCAASGFTFDDYAIGWFRQAPGKEREGVSGIS
SSDGNTYYADSVKGRFTISSDNAKNTVYLQMNSLKPEDTAVYYCAAEPPDSNWYLD
GSPEFFKFWGQGTQVTVSS

< > PMP31C8(t), SEQ ID NO: 412; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP31C5(t), SEQ ID NO: 413; PRT; ->
EVQLVESGGGLVQAGGSLRLSCAASGFTFDDYAIGWFRQAPGKEREGVSCIS
SSDGSTYYADSVKGRFTISSDNAKNTVYLLMNSLKPEDTAVYYCAAEPPDSMWSLD
GSPEFFKFWGQGTQVTVSS

< > PMP31B4(t), SEQ ID NO: 414; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP31B11(t), SEQ ID NO: 415; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP30G11(t), SEQ ID NO: 416; PRT; ->
EVQLVESGGGLVQPGGSLRLSCVASGFSLDYYVIGWFRQAPGKEREGVSCISS
SDGSTYYADSVKGRFTISRDNAKNTVYLQMNSLKPEDTAVYYCAADLLRTPEFCVD
SAPYDYWGQGTQVTVSS

< > PMP30B6(t), SEQ ID NO: 417; PRT; ->
EVQLVESGGGLVQPGGSLRLSCAASGFTLDYYVIGWFRQAPGKEREAVACIS
SSDRSTYYADSVKGRFTISRDNAKNTGYLQMNSLKPEDTAVYYCAADLLRTPEFCSD
SAPYDYWGQGTQVTVSS

< > PMP30B1(t), SEQ ID NO: 418; PRT; ->
EVQLVESGGGLVQPGGSLRLSCAASGFTLDYYAIGWWRQAPGKGREGVSCIS
SGDGSTNYADSVKGRFTISRDNAKNTVYLQMNSLKPEDTAVYYCATDRSVYYCSGG
APEEYYWGQGTQVTVSS

TABLE B-1-continued

Nanobodies and polypeptides against the IL-6 receptor.

< > PMP30A2(t), SEQ ID NO: 419; PRT; ->
EVQLVESGGGLVQPGGSLRLSCAASGFTLDYYVIGWFRQAPGKEREGVSCIG
SSDDSTYYADSVKGRFTISRDNAKNTVYLQMNSLKPEDTAVYYCAADLLRTPEFCT
DSAPYDYWGQGTQVTVSS

< > PMP30A10(t), SEQ ID NO: 420; PRT; ->
EVQLVESGGGLVQPGGSLRLSCAASGFTFDDYGMSWVRQAPGKGLEWVSAI
SWNGGSTYYTESMKGRFTISRDNAKNTVYLQMNSLKPEDTAVYYCVKGSTAIVGVP
PTYPDEYDYWGQGTQVTVSS

< > PMP28H6(t), SEQ ID NO: 421; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP28F7(t), SEQ ID NO: 422; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP28D4(t), SEQ ID NO: 423; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP28C7(t), SEQ ID NO: 424; PRT; ->
EVQLVESGGGLVQPGGSLRLSCAASGFTFGSYDMSWVRQAPGKGPEWVSAI
NSGGDNTYYADSVKGRFTISRDNAKNTLYLQMNSLKPEDTAVYYCATDWRYSDYD
LPLPPPGDYWGQGTQVTVSS

< > PMP28B1(t), SEQ ID NO: 425; PRT; ->
EVQLVESGGGLVQPGGSLRLSCAASGFTLNYYAIGWFRQAPGKEREGVSCISS
SDGSTYYADSVKGRFTISRDNAKNTFYLQMNSLKPEDTAVYYCAAEGLGDSDSPCG
AAWYNDYWGQGTQVTVSS

< > PMP28A2(t), SEQ ID NO: 426; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< > PMP40H5, SEQ ID NO: 427; PRT; ->
EVQLVESGGGLVQPGGSLRLSCAASGFSLDYYAIGWFRQAPGKEREGVSCM
DSSSGTTSTYYSDSVKGRFTISRDDAKNTVYLQMNSLKPEDTAVYYCAADGHLNWG
QRYVPCSQISWRGWNDYWGQGTQVTVSS

< >PMP35H4, SEQ ID NO: 428; PRT; ->
EVQLVESGGGLVQPGGSLRLSCAASGFTFDDYGMSWVRQAPGRATEWVSAI
SWNGNNTYYTESMKGRFTISRDNAKNTVYLQMNSLKPEDTAVYYCVKGSTAIVGV
PPTYPDEYDYWGQGTQVTVSS

< >PMP35F4, SEQ ID NO: 429; PRT; ->
EVQLVESGGGLVQAGGSLRLSCAASGRTFSSYDMGWYRQAPGKEREFVAIIT
WNSSTYYADSVKGRFTISRDNAKNTVYLQMNSLKPEDTAIYYCNAQYGLGYAEDY
WGQGTQVTVSS

< >PMP35E11, SEQ ID NO: 430; PRT; ->
EVQLVESGGGLVQAGGSLRLSCAASGFTFDDYAIGWFRQAPGKEHEGVSCIS
SSDGSTYYADSVKGRFTISSDNAKNTVYLQMNSLKPEDTAVYYCAAERDVPARSLC
GSYYWYDYRGQGTQVTVSS

< >PMP35C10, SEQ ID NO: 431; PRT; ->
EVQLVESGGGLVQAGGSLRLSCAASGRTFSSYDMGWYRQAPGKEREFVAVI
HWSSGSTYYADPVKGRFTISRDNAKNTVYLQMNSLKPEDTAIYYCNAFLPGPEGFH
DYWGQGTQVTVSS

< >PMP34G9, SEQ ID NO: 432; PRT; ->
EVQLVESGGGLVQAGGSLRLSCAASGRTSSSYDMTWYRQVPGKEREFVAVIS
WSGGSTYYADSVKGRFTISRDNAKNTVYLQMNSLKPEDTAIYYCNAYTGGGDDYW
GQGTQVTVSS

< >PMP34G3, SEQ ID NO: 433; PRT; ->
EVQLVESGGGLVQPGGSLRLSCAASGFTLDYYAIGWFRQAPGKERERVSCISS
SDGSTYYADSVKGRFTISRDNAKNTVYLQMNSLKPEDTAAYYCATDRSVYYCSGGA
PEEYYWGQGTQVTVSS

TABLE B-1-continued

Nanobodies and polypeptides against the IL-6 receptor.

< >PMP34E10, SEQ ID NO: 434; PRT; ->
EVQLVESGGGLVQAGGSLRLSCAASGRTFSSYAMGWGRQAPGKEREFVATIS
WSGGSTYYADSVKGRFTISRDNAKNTVYLQMNSLKPEDTAVYYCAADLAEFKYSD
YADYWGQGTQVTVSS

< >PMP34C11, SEQ ID NO: 435; PRT; ->
EVQLVESGGGLVQPGGSLRLSCAAAGFTLDYSAIGWFRQAPGKEREMFSCIS
GSDGSTWYADSVAGRFTISFDNAKNTVYLQMNSLKPEDTGLYICAVTGGVRGPCAY
EYEYWGQGTQVTVSS

< >PMP34A12, SEQ ID NO: 436; PRT; ->
EVQLVESGGGLVQPGGSLRLSCVASGFSLDYYVIGWFRQAPGKEREGVSCISS
SDGSTYYADSVKGRFTISRDNAKNTVYLQMNSLKPEDTAVYYCAADLLRTPEFCVD
SAPYDYWGQGTQVTVSS

< >PMP33A3, SEQ ID NO: 437; PRT; ->
EVQLVESGGGLVQPGGSLRLSCAASGFTLDYGAIGWFRQAPGKEREGVSCISS
STGSTYYADSVKGRFTISRDNGKNTVYLQMNSLKPEDTAVYYCAADKMWSPCLVA
ANEEALFEYDYWGQGTQVTVSS

< >PMP32E2, SEQ ID NO: 438; PRT; ->
EVQLVESGGGLVQAGGSLRLSCAASGNIFDDNTMGWTWNRQPPGKQRELVA
IIATDGSTNYADSVKGRFTISRDNAKNTVYLQMNSLKPEDTAVYYCNLFSLRLGRDY
WGQGTQVTVSS

< >PMP32E10, SEQ ID NO: 439; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSS

< >PMP32C9, SEQ ID NO: 440; PRT; ->
EVQLVESGGGLVQAGGSLRLSCAASGFTFDDYDIGWFRQAPGKEREGVSGIS
SSDGNTYYADSVKGRFTISSDNAKNTVYLQMNSLKPEDTAVYYCAAEPPDSSWYLD
GSPEFFKYWGQGTQVTVSS

< >PMP31A4, SEQ ID NO: 441; PRT; ->
EVQLVESGGGLVQAGGSLRLSCAASGSIFKVNAMGWYRQAPGKQRELVAGII
SGGSTNYADSVKGRLTISRDNAKNTVYLQMNSLKPEDTAVYYCSFVTTNSDYDLGR
DYWGQGTQVTVSS

< >PMP30C11, SEQ ID NO: 442; PRT; ->
EVQLVESGGGLVQAGGSLRLSCAASGRTFSSYDMGWYRQAPGKEREFVAVI
SRSGSSTYYADSVKGRFTISRDNAKNTVYLQMNSLKPEDTAIYYCKAEVVAGDYDY
WGQGTQVTVSS

< >PMP28G3, SEQ ID NO: 443; PRT; ->
EVQLVESGGGLVQAGGSLRLSCTASGNIFSTETMGWYRQPPGKQRDVVATIT
HGGTTNYADSVKGRFTISRDNRKNTVYLQMNSLKPEDTGVYYCNARSSWYSPEYW
GQGTQVTVSS

< >PMP28E11, SEQ ID NO: 444; PRT; ->
EVQLVESGGGFVQAGGSLRLSCIASGDNFSINRMGWYRQALGKQRELVAIIT
NHGSTNYADAVKGRFTISRDYAKNTVYLQMNGLKPDDTAVYYCNAYISEVGTWRD
DYWGQGIQVTVSS

< > 059B.IL6-R.cl5.7(t), SEQ ID NO: 445; PRT; ->
EVQLVESGGGLVQAGGSLRLSCAASGRTFSGADAGWNRQTPGKEREFVAAI
NWSGNSTYYADSVKGRFTVSRDNAKNTVYLQMNSLKPEDTAVYYCHAFRDDYYSE
GKGTLVTVSS

< > 059A.IL6-Rcl4(t), SEQ ID NO: 446; PRT; ->
EVQLVESGGGLVQAGGSLRLSCAASGRTLSSYDMGWYRQGPGKEREFVAAI
SWSGGGTDYVDSVKGRFTISRDTAKNTMYLQMNSLKPEDTAIYYCNALGTTDSDYE
GELYWGQGTQVTVSS

< > 059A.IL6-Rcl3(t), SEQ ID NO: 447; PRT; ->
EVQLVESGGGLVQPGGSLRLSCAASGFTLDSYAIGWFRQAPGKEPEGVSCIST
SDGSTYYADSVKGRFTISRDNAKNTVYLQMNSLKPEDTAVYYCTADGGPHAPLTVQ
DMCVMAIADYWGQGTQVTVSS

< > 059A.IL6-Rcl2(t), SEQ ID NO: 448; PRT; ->
EVQLVESGGGLVQAGGSLRSCAASGRTFSNIAMGWIREAPGKEREFVAALT
WSGGSTYYADSVKGRFTISRDSAKNTVYLQMNKLKPEDTAVYYCVADEEIHLIVSISI
ADFWGQGTQVTVSS

TABLE B-1-continued

Nanobodies and polypeptides against the IL-6 receptor.

< > 059A.IL6-Rc11(t), SEQ ID NO: 449; PRT; ->
EVQLVESGGGLVQAGGSLRLSCAASGLTDDDFAIGWFRQAPGKEPEGVSCISS
SDGSTYYADSVKGRFTISSDNAKNTVYLQMNSLKPEDTAVYFCTALFDRCGSTWYY
GMDYWGKGTLVTVSS

Bispecific polypeptides against the IL6 receptor

< >063.IL-6RPMP35C10cl8, SEQ ID NO: 450; PRT; ->
EVQLVESGGGLVQAGGSLRLSCAASGRTFSSYDMGWYRQAPGKEREFVAVI
HWSSGSTYYADPVKGRFTISRDNAKNTVYLQMNSLKPEDTAIYYCNAFLPGPEGFH
DYWGQGTQVTVSSGGGGSGGGSEVQLVESGGGLVQPGNSLRLSCAASGFTFRSFGM
SWVRQAPGKEPEWVSSISGSGSDTLYADSVKGRFTISRDNAKTTLYLQMNSLKPEDT
AVYYCTIGGSLSRSSQGTQVTVSS

< >063.IL-6RPMP34G9cl2, SEQ ID NO: 451; PRT; ->
EVQLVESGGGLVQAGGSLRLSCAASGRTSSSYDMTWYRQVPGKEREFVAVIS
WSGGSTYYADSVKGRFTISRDNAKNTVYLQMNSLKPEDTAIYYCNAYTGGGDDYW
GQGTQVTVSSGGGGSGGGSEVQLVESGGGLVQPGNSLRLSCAASGFTFRSFGMSWV
RQAPGKEPEWVSSISGSGSDTLYADSVKGRFTISRDNAKTTLYLQMNSLKPEDTAVY
YCTIGGSLSRSSQGTQVTVSS

< >063.IL-6RPMP34G3cl4-5, SEQ ID NO: 452; PRT; ->
EVQLVESGGGLVQPGGSLRLSCAASGFTLDYYAIGWFRQAPGKERERVSCISS
SDGSTYYADSVKGRFTISRDNAKNTVYLQMNSLKPEDTAAYYCATDRSVYYCSGGA
PEEYYWGQGTQVTVSSGGGGSGGGSEVQLVESGGGLVQPGNSLRLSCAASGFTFRS
FGMSWVRQAPGKEPEWVSSISGSGSDTLYADSVKGRFTISRDNAKTTLYLQMNSLKP
EDTAVYYCTIGGSLSRSSQGTQVTVSS

< >063.IL-6RPMP34A12cl2, SEQ ID NO: 453; PRT; ->
EVQLVESGGGLVQPGGSLRLSCVASGFSLDYYVIGWFRQAPGKEREGVSCISS
SDGSTYYADSVKGRFTISRDNAKNTVYLQMNSLKPEDTAVYYCAADLLRTPEFCVD
SAPYDYWGQGTQVTVSSGGGGSGGGSEVQLVESGGGLVQPGNSLRLSCAASGFTFR
SFGMSWVRQAPGKEPEWVSSISGSGSDTLYADSVKGRFTISRDNAKTTLYLQMNSLK
PEDTAVYYCTIGGSLSRSSQGTQVTVSS

< >063.IL-6RPMP31A4cl4, SEQ ID NO: 454; PRT; ->
EVQLVESGGGLVQAGGSLRLSCAASGSIFKVNAMGWYRQAPGKQRELVAGII
SGGSTNYADSVKGRLTISRDNAKNTVYLQMNSLKPEDTAVYYCSFVTTNSDYDLGR
DYWGQGTQVTVSSGGGGSGGGSEVQLVESGGGLVQPGNSLRLSCAASGFTFRSFGM
SWVRQAPGKEPEWVSSISGSGSDTLYADSVKGRFTISRDNAKTTLYLQMNSLKPEDT
AVYYCTIGGSLSRSSQGTQVTVSS

< >063.IL-6R.PMP40H5cl4, SEQ ID NO: 455; PRT; ->
EVQLVESGGGLVQPGGSLRLSCAASGFSLDYYAIGWFRQAPGKEREGVSCM
DSSSGTTSTYYSDSVKGRFTISRDDAKNTVYLQMNSLKPEDTAVYYCAADGHLNWG
QRYVPCSQISWRGWNDYWGQGTQVTVSSGGGGSGGGSEVQLVESGGGLVQPGNSL
RLSCAASGFTFRSFGMSWVRQAPGKEPEWVSSISGSGSDTLYADSVKGRFTISRDNA
KTTLYLQMNSLKPEDTAVYYCTIGGSLSRSSQGTQVTVSS

< >063.IL-6R.PMP35F4cl3, SEQ ID NO: 456; PRT; ->
EVQLVESGGGLVQAGGSLRLSCAASGRTFSSYDMGWYRQAPGKEREFVAIIT
WNSSTYYADSVKGRFTISRDNAKNTVYLQMNSLKPEDTAIYYCNAQYGLGYAEDY
WGQGTQVTVSSGGGGSGGGSEVQLVESGGGLVQPGNSLRLSCAASGFTFRSFGMSW
VRQAPGKEPEWVSSISGSGSDTLYADSVKGRFTISRDNAKTTLYLQMNSLKPEDTAV
YYCTIGGSLSRSSQGTQVTVSS

< >063.IL-6R.PMP35E11cl1, SEQ ID NO: 457; PRT; ->
EVQLVESGGGLVQAGGSLRLSCAASGFTFDDYAIGWFRQAPGKEHEGVSCIS
SSDGSTYYADSVKGRFTISSDNAKNTVYLQMNSLKPEDTAVYYCAAERDVPARSLC
GSYYWYDYRGQGTQVTVSSGGGGSGGGSEVQLVESGGGLVQPGNSLRLSCAASGF
TFRSFGMSWYRQAPGKEPEWVSSISGSGSDTLYADSVKGRFTISRDNAKTTLYLQMN
SLKPEDTAVYYCTIGGSLSRSSQGTQVTVSS

< >063.IL-6R.PMP34E10cl3, SEQ ID NO: 458; PRT; ->
EVQLVESGGGLVQAGGSLRLSCAASGRTFSSYAMGWGRQAPGKEREFVATIS
WSGGSTYYADSVKGRFTISRDNAKNTVYLQMNSLKPEDTAVYYCAADLAEFKYSD
YADYWGQGTQVTVSSGGGGSGGGSEVQLVESGGGLVQPGNSLRLSCAASGFTFRSF
GMSWVRQAPGKEPEWVSSISGSGSDTLYADSVKGRFTISRDNAKTTLYLQMNSLKP
EDTAVYYCTIGGSLSRSSQGTQVTVSS

< >063.IL-6R.PMP34C11cl3, SEQ ID NO: 459; PRT; ->
EVQLVESGGGLVQPGGSLRLSCAAAGFTLDYSAIGWFRQAPGKEREMFSCIS
GSDGSTWYADSVAGRFTISFDNAKNTVYLQMNSLKPEDTGLYICAVTGGVRGPCAY
EYEYWGQGTQVTVSSGGGGSGGGSEVQLVESGGGLVQPGNSLRLSCAASGFTFRSF
GMSWVRQAPGKEPEWVSSISGSGSDTLYADSVKGRFTISRDNAKTTLYLQMNSLKP
EDTAVYYCTIGGSLSRSSQGTQVTVSS

TABLE B-1-continued

Nanobodies and polypeptides against the IL-6 receptor.

```
< >063.IL-6R.PMP33A3cl1, SEQ ID NO: 460; PRT; ->
EVQLVESGGGLVQPGGSLRLSCAASGFTLDYGAIGWFRQAPGKEREGVSCISS
STGSTYYADSVKGRFTISRDNGKNTVYLQMNSLKPEDTAVYYCAADKMWSPCLVA
ANEEALFEYDYWGQGTQVTVSSGGGGSGGGSEVQLVESGGGLVQPGNSLRLSCAAS
GFTFRSFGMSWVRQAPGKEPEWVSSISGSGSDTLYADSVKGRFTISRDNAKTTLYLQ
MNSLKPEDTAVYYCTIGGSLSRSSQGTQVTVSS

< >063.IL-6R.PMP32E2cl4, SEQ ID NO: 461; PRT; ->
EVQLVESGGGLVQAGGSLRLSCAASGNIFDDNTMGWTWNRQPPGKQRELVA
IIATDGSTNYADSVKGRFTISRDNAKNTVYLQMNSLKPEDTAVYYCNLFSLRLGRDY
WGQGTQVTVSSGGGGSGGGSEVQLVESGGGLVQPGNSLRLSCAASGFTFRSFGMSW
VRQAPGKEPEWVSSISGSGSDTLYADSVKGRFTISRDNAKTTLYLQMNSLKPEDTAV
YYCTIGGSLSRSSQGTQVTVSS

< >063.IL-6R.PMP32E10cl1, SEQ ID NO: 462; PRT; ->
EVQLVESGGGLVQPGGSLRLSCAASGFTFGSYDMSWVRQAPGKGPEWVSAI
NSGGGSTYYADSVKGRFTISRDNAKNTLYLQMNSLKPEDTAVYYCATDWRYSDYD
LPLPPPGDYWGQGTQVTVSSGGGGSGGGSEVQLVESGGGLVQPGNSLRLSCAASGF
TFRSFGMSWVRQAPGKEPEWVSSISGSGSDTLYADSVKGRFTISRDNAKTTLYLQMN
SLKPEDTAVYYCTIGGSLSRSSQGTQVTVSS

< >063.IL-6R.PMP32C9cl2, SEQ ID NO: 463; PRT; ->
EVQLVESGGGLVQAGGSLRLSCAASGFTFDDYDIGWFRQAPGKEREGVSGIS
SSDGNTYYADSVKGRFTISSDNAKNTVYLQMNSLKPEDTAVYYCAAEPPDSSWYLD
GSPEFFKYWGQGTQVTVSSGGGGSGGGSEVQLVESGGGLVQPGNSLRLSCAASGFT
FRSFGMSWVRQAPGKEPEWVSSISGSGSDTLYADSVKGRFTISRDNAKTTLYLQMNS
LKPEDTAVYYCTIGGSLSRSSQGTQVTVSS

< >063.IL-6R.PMP30C11cl2, SEQ ID NO: 464; PRT; ->
EVQLVESGGGLVQAGGSLRLSCAASGRTFSSYDMGWYRQAPGKEREFVAVI
SRSGSSTYYADSVKGRFTISRDNAKNTVYLQMNSLKPEDTAIYYCKAEVVAGDYDY
WGQGTQVTVSSGGGGSGGGSEVQLVESGGGLVQPGNSLRLSCAASGFTFRSFGMSW
VRQAPGKEPEWVSSISGSGSDTLYADSVKGRFTISRDNAKTTLYLQMNSLKPEDTAV
YYCTIGGSLSRSSQGTQVTVSS

< >063.IL-6R.PMP28G3cl3, SEQ ID NO: 465; PRT; ->
EVQLVESGGGLVQAGGSLRLSCTASGNIFSTETMGWYRQPPGKQRDVVATIT
HGGTTNYADSVKGRFTISRDNRKNTVYLQMNSLKPEDTGVYYCNARSSWYSPEYW
GQGTQVTVSSGGGGSGGGSEVQLVESGGGLVQPGNSLRLSCAASGFTFRSFGMSWV
RQAPGKEPEWVSSISGSGSDTLYADSVKGRFTISRDNAKTTLYLQMNSLKPEDTAVY
YCTIGGSLSRSSQGTQVTVSS

< >063.IL-6R.PMP28E11cl4, SEQ ID NO: 466; PRT; ->
EVQLVESGGGFVQAGGSLRLSCIASGDNFSINRMGWYRQALGKQRELVAIIT
NHGSTNYADAVKGRFTISRDYAKNTVYLQMNGLKPDDTAVYYCNAYISEVGTWRD
DYWGQGIQVTVSSGGGGSGGGSEVQLVESGGGLVQPGNSLRLSCAASGFTFRSFGM
SWVRQAPGKEPEWVSSISGSGSDTLYADSVKGRFTISRDNAKTTLYLQMNSLKPEDT
AVYYCTIGGSLSRSSQGTQVTVSS

< > 059B.IL6-R.cl5.7(t), SEQ ID NO: 467; PRT; ->
EVQLVESGGGLVQAGGSLRLSCAASGRTFSGADAGWNRQTPGKEREFVAAI
NWSGNSTYYADSVKGRFTVSRDNAKNTVYLQMNSLKPEDTAVYYCHAFRDDYYSE
GKGTLVTVSSGGGGSGGGSEVQLVESGGGLVQPGNSLRLSCAASGFTFRSFGMSWV
RQAPGKEPEWVSSISGSGSDTLYADSVKGRFTISRDNAKTTLYLQMNSLKPEDTAVY
YCTIGGSLSRSSQGTQVTVSS

< > 059A.IL6-Rcl4(t), SEQ ID NO: 468; PRT; ->
EVQLVESGGGLVQAGGSLRLSCAASGRTLSSYDMGWYRQGPGKEREFVAAI
SWSGGGTDYVDSVKGRFTISRDTAKNTMYLQMNSLKPEDTAIYYCNALGTTDSDYE
GELYWGQGTQVTVSSGGGGSGGGSEVQLVESGGGLVQPGNSLRLSCAASGFTFSSF
GMSWVRQAPGKGLEWVSSISGSGSDTLYADSVKGRFTISRDNAKTTLYLQMNSLRP
EDTAVYYCTIGGSLSRSSQGTLVTVSS

< > 059A.IL6-Rcl3(t), SEQ ID NO: 469; PRT; ->
EVQLVESGGGLVQPGGSLRLSCAASGFTLDSYAIGWFRQAPGKEPEGVSCIST
SDGSTYYADSVKGRFTISRDNAKNTVYLQMNSLKPEDTAVYYCTADGGPHAPLTVQ
DMCVMAIADYWGQGTQVTVSSGGGGSGGGSEVQLVESGGGLVQPGNSLRLSCAAS
GFTFSSFGMSWVRQAPGKGLEWVSSISGSGSDTLYADSVKGRFTISRDNAKTTLYLQ
MNSLRPEDTAVYYCTIGGSLSRSSQGTLVTVSS

< > 059A.IL6-Rcl2(t), SEQ ID NO: 470; PRT; ->
EVQLVESGGGLVQAGGSLRLSCAASGRTFSNIAMGWIREAPGKEREFVAALT
WSGGGSTYYADSVKGRFTISRDSAKNTVYLQMNKLKPEDTAVYYCVADEEIHLIVSISI
ADFWGQGTQVTVSSGGGGSGGGSEVQLVESGGGLVQPGNSLRLSCAASGFTFSSFG
MSWVRQAPGKGLEWVSSISGSGSDTLYADSVKGRFTISRDNAKTTLYLQMNSLRPE
DTAVYYCTIGGSLSRSSQGTLVTVSS
```

TABLE B-1-continued

Nanobodies and polypeptides against the IL-6 receptor.

< > 059A.IL6-Rc11(t), SEQ ID NO: 471; PRT; ->
EVQLVESGGGLVQAGGSLRLSCAASGLTDDDFAIGWFRQAPGKEPEGVSCISS
SDGSTYYADSVKGRFTISSDNAKNTVYLQMNSLKPEDTAVYFCTALFDRCGSTWYY
GMDYWGKGTLVTVSSGGGGSGGGSEVQLVESGGGLVQPGNSLRLSCAASGFTFSSF
GMSWVRQAPGKGLEWVSSISGSGSDTLYADSVKGRFTISRDNAKTTLYLQMNSLRP
EDTAVYYCTIGGSLSRSSQGTLVTVSS

Leader sequences and N-terminal sequences

< > llama leader 1, SEQ ID NO: 472; PRT; ->
VKKLLFAIPLVVPFYAAQPAMA

< > llama leader 2, SEQ ID NO: 473; PRT; ->
VKKLLFAIPLVVPFYAAQPAIA

< > llama leader 3, SEQ ID NO: 474; PRT; -> FELASVAQA

< > leader sequence, SEQ ID NO: 475; PRT; ->
MKKTAIAIAVALAGLATVAQA

< > leader sequence, SEQ ID NO: 476; PRT; ->
MKKTAIAFAVALAGLATVAQA

< > N-terminal sequence, SEQ ID NO: 477; PRT; ->
AAAEQKLISEEDLNGAAHHHHHH**

Trivalent bispecific polypeptides directed against the IL-6 receptor and human serum albumin < IL6R43, SEQ ID NO: 478"; PRT; ->"
EVQLVESGGGLVQAGGSLRLSCAASGSIFKVNAMGWYRQAPGKQRELVAGII
SGGSTNYADSVKGRLTISRDNAKNTVYLQMNSLKPEDTAVYYCSFVTTNSDYDLGR
DYWGQGTQVTVSSGGGGSGGGSAVQLVESGGGLVQPGNSLRLSCAASGFTFRSFG
MSWVRQAPGKEPEWVSSISGSGSDTLYADSVKGRFTISRDNAKTTLYLQMNSLKPE
DTAVYYCTIGGSLSRSSQGTQVTVSSGGGGSGGGSEVQLVESGGGLVQAGGSLRLSC
AASGSIFKVNAMGWYRQAPGKQRELVAGIISGGSTNYADSVKGRLTISRDNAKNTV
YLQMNSLKPEDTAVYYCSFVTTNSDYDLGRDYWGQGTQVTVSS < IL6R44, SEQ ID NO: 479"; PRT; ->"
EVQLVESGGGLVQAGGSLRLSCAASGFTFDDYDIGWFRQAPGKEREGVSGIS
SSDGNTYYADSVKGRFTISSDNAKNTVYLQMNSLKPEDTAVYYCAAEPPDSSWYLD
GSPEFFKYWGQGTQVTVSSGGGGSGGGSAVQLVESGGGLVQPGNSLRLSCAASGFT
FRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLVQAGGSL
RLSCAASGFTFDDYDIGWFRQAPGKEREGVSGISSSDGNTYYADSVKGRFTISSDNA
KNTVYLQMNSLKPEDTAVYYCAAEPPDSSWYLDGSPEFFKYWGQGTQVTVSS < IL6R49, SEQ ID NO: 480"; PRT; ->"
EVQLVESGGGLVQAGGSLRLSCAASGRTSSSYDMTWYRQVPGKEREFVAVIS
WSGGSTYYADSVKGRFTISRDNAKNTVYLQMNSLKPEDTAIYYCNAYTGGGDDYW
GQGTQVTVSSGGGGSGGGSAVQLVESGGGLVQPGNSLRLSCAASGFTFRSFGMSWV
RQAPGKEPEWVSSISGSGSDTLYADSVKGRFTISRDNAKTTLYLQMNSLKPEDTAVY
YCTIGGSLSRSSQGTQVTVSSGGGGSGGGSEVQLVESGGGLVQAGGSLRLSCAASGR
TSSSYDMTWYRQVPGKEREFVAVISWSGGSTYYADSVKGRFTISRDNAKNTVYLQM
NSLKPEDTAIYYCNAYTGGGDDYWGQGTQVTVSS < IL6R53, SEQ ID NO: 481"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLKPEDTAVYYCVKGSTAIVGV
PPTYPDEYDYWGQGTQVTVSSGGGGSGGGSAVQLVESGGGLVQPGNSLRLSCAASG
FTFRSFGMSWVRQAPGKEPEWVSSISGSGSDTLYADSVKGRFTISRDNAKTTLYLQM
NSLKPEDTAVYYCTIGGSLSRSSQGTQVTVSSGGGGSGGGSEVQLVESGGGLVQPGG
SLRLSCAASGFTFDDYGMSWVRQAPGRATEWVSAISWNGNNTYYTESMKGRFTISR
DNAKNTVYLQMNSLKPEDTAVYYCVKGSTAIVGVPPTYPDEYDYWGQGTQVTVSS < IL6R54, SEQ ID NO: 482"; PRT; ->"
EVQLVESGGGLVQPGGSLRLSCAASGFSLDYYAIGWFRQAPGKEREGVSCM
DSSSGTTSTYYSDSVKGRFTISRDDAKNTVYLQMNSLKPEDTAVYYCAADGHLNWG
QRYVPCSQISWRGWNDYWGQGTQVTVSSGGGGSGGGSAVQLVESGGGLVQPGNSL
RLSCAASGFTFRSFGMSWVRQAPGKEPEWVSSISGSGSDTLYADSVKGRFTISRDNA
KTTLYLQMNSLKPEDTAVYYCTIGGSLSRSSQGTQVTVSSGGGGSGGGSEVQLVESG
GGLVQPGGSLRLSCAASGFSLDYYAIGWFRQAPGKEREGVSCMDSSSGTTSTYYSDS
VKGRFTISRDDAKNTVYLQMNSLKPEDTAVYYCAADGHLNWGQRYVPCSQISWRG
WNDYWGQGTQVTVSS TABLE B-1-continued Nanobodies and polypeptides against the IL-6 receptor.

```
< , SEQ ID NO: 483"; PRT; ->"
AVQLVESGGGLVQPGNSLRLSCAASGFTFRSFGMSWVRQAPGKEPEWVSSIS
GSGSDTLYADSVKGRFTISRDNAKTTLYLQMNSLKPEDTAVYYCTIGGSLSRSSQGT
QVTVSSGGGGSGGGSEVQLVESGGGLVQAGGSLRLSCAASGSIFKVNAMGWYRQA
PGKQRELVAGIISGGSTNYADSVKGRLTISRDNAKNTVYLQMNSLKPEDTAVYYCSF
VTTNSDYDLGRDYWGQGTQVTVSSGGGGSGGGSEVQLVESGGGLVQAGGSLRLSC
AASGSIFKVNAMGWYRQAPGKQRELVAGIISGGSTNYADSVKGRLTISRDNAKNTV
YLQMNSLKPEDTAVYYCSFVTTNSDYDLGRDYWGQGTQVTVSS

< , SEQ ID NO: 484"; PRT; ->"
AVQLVESGGGLVQPGNSLRLSCAASGFTFRSFGMSWVRQAPGKEPEWVSSIS
GSGSDTLYADSVKGRFTISRDNAKTTLYLQMNSLKPEDTAVYYCTIGGSLSRSSQGT
QVTVSSGGGGSGGGSEVQLVESGGGLVQAGGSLRLSCAASGFTFDDYDIGWFRQAP
GKEREGVSGISSSDGNTYYADSVKGRFTISSDNAKNTVYLQMNSLKPEDTAVYYCA
AEPPDSSWYLDGSPEFFKYWGQGTQVTVSSGGGGSGGGSEVQLVESGGGLVQAGGS
LRLSCAASGFTFDDYDIGWFRQAPGKEREGVSGISSSDGNTYYADSVKGRFTISSDNA
KNTVYLQMNSLKPEDTAVYYCAAEPPDSSWYLDGSPEFFKYWGQGTQVTVSS

< , SEQ ID NO: 485"; PRT; ->"
AVQLVESGGGLVQPGNSLRLSCAASGFTFRSFGMSWVRQAPGKEPEWVSSIS
GSGSDTLYADSVKGRFTISRDNAKTTLYLQMNSLKPEDTAVYYCTIGGSLSRSSQGT
QVTVSSGGGGSGGGSEVQLVESGGGLVQAGGSLRLSCAASGRTSSSYDMTWYRQV
PGKEREFVAVISWSGGSTYYADSVKGRFTISRDNAKNTVYLQMNSLKPEDTAIYYCN
AYTGGGDDYWGQGTQVTVSSGGGGSGGGSEVQLVESGGGLVQAGGSLRLSCAASG
RTSSSYDMTWYRQVPGKEREFVAVISWSGGSTYYADSVKGRFTISRDNAKNTVYLQ
MNSLKPEDTAIYYCNAYTGGGDDYWGQGTQVTVSS

< , SEQ ID NO: 486"; PRT; ->"
AVQLVESGGGLVQPGNSLRLSCAASGFTFRSFGMSWVRQAPGKEPEWVSSIS
GSGSDTLYADSVKGRFTISRDNAKTTLYLQMNSLKPEDTAVYYCTIGGSLSRSSQGT
QVTVSSGGGGSGGGSEVQLVESGGGLVQPGGSLRLSCAASGFTFDDYGMSWVRQA
PGRATEWVSAISWNGNNTYYTESMKGRFTISRDNAKNTVYLQMNSLKPEDTAVYY
CVKGSTAIVGVPPTYPDEYDYWGQGTQVTVSSGGGGSGGGSEVQLVESGGGLVQPG
GSLRLSCAASGFTFDDYGMSWVRQAPGRATEWVSAISWNGNNTYYTESMKGRFTIS
RDNAKNTVYLQMNSLKPEDTAVYYCVKGSTAIVGVPPTYPDEYDYWGQGTQVTVSS

< , SEQ ID NO: 487"; PRT; ->"
AVQLVESGGGLVQPGNSLRLSCAASGFTFRSFGMSWVRQAPGKEPEWVSSIS
GSGSDTLYADSVKGRFTISRDNAKTTLYLQMNSLKPEDTAVYYCTIGGSLSRSSQGT
QVTVSSGGGGSGGGSEVQLVESGGGLVQPGGSLRLSCAASGFSLDYYAIGWFRQAP
GKEREGVSCMDSSSGTTSTYYSDSVKGRFTISRDDAKNTVYLQMNSLKPEDTAVYY
CAADGHLNWGQRYVPCSQISWRGWNDYWGQGTQVTVSSGGGGSGGGSEVQLVES
GGGLVQPGGSLRLSCAASGFSLDYYAIGWFRQAPGKEREGVSCMDSSSGTTSTYYSD
SVKGRFTISRDDAKNTVYLQMNSLKPEDTAVYYCAADGHLNWGQRYVPCSQISWR
GWNDYWGQGTQVTVSS

< , SEQ ID NO: 488"; PRT; ->"
EVQLVESGGGLVQAGGSLRLSCAASGSIFKVNAMGWYRQAPGKQRELVAGII
SGGSTNYADSVKGRLTISRDNAKNTVYLQMNSLKPEDTAVYYCSFVTTNSDYDLGR
DYWGQGTQVTVSSGGGGSGGGSEVQLVESGGGLVQAGGSLRLSCAASGSIFKVNA
MGWYRQAPGKQRELVAGIISGGSTNYADSVKGRLTISRDNAKNTVYLQMNSLKPED
TAVYYCSFVTTNSDYDLGRDYWGQGTQVTVSSGGGGSGGGSAVQLVESGGGLVQP
GNSLRLSCAASGFTFRSFGMSWVRQAPGKEPEWVSSISGSGSDTLYADSVKGRFTISR
DNAKTTLYLQMNSLKPEDTAVYYCTIGGSLSRSSQGTQVTVSS

< , SEQ ID NO: 489"; PRT; ->"
EVQLVESGGGLVQAGGSLRLSCAASGFTFDDYDIGWFRQAPGKEREGVSGIS
SSDGNTYYADSVKGRFTISSDNAKNTVYLQMNSLKPEDTAVYYCAAEPPDSSWYLD
GSPEFFKYWGQGTQVTVSSGGGGSGGGSEVQLVESGGGLVQAGGSLRLSCAASGFT
FDDYDIGWFRQAPGKEREGVSGISSSDGNTYYADSVKGRFTISSDNAKNTVYLQMNS
LKPEDTAVYYCAAEPPDSSWYLDGSPEFFKYWGQGTQVTVSSGGGGSGGGSAVQL
VESGGGLVQPGNSLRLSCAASGFTFRSFGMSWVRQAPGKEPEWVSSISGSGSDTLYA
DSVKGRFTISRDNAKTTLYLQMNSLKPEDTAVYYCTIGGSLSRSSQGTQVTVSS

< , SEQ ID NO: 490"; PRT; ->"
EVQLVESGGGLVQAGGSLRLSCAASGRTSSSYDMTWYRQVPGKEREFVAVIS
WSGGSTYYADSVKGRFTISRDNAKNTVYLQMNSLKPEDTAIYYCNAYTGGGDDYW
GQGTQVTVSSGGGGSGGGSEVQLVESGGGLVQAGGSLRLSCAASGRTSSSYDMTW
YRQVPGKEREFVAVISWSGGSTYYADSVKGRFTISRDNAKNTVYLQMNSLKPEDTAI
YYCNAYTGGGDDYWGQGTQVTVSSGGGGSGGGSAVQLVESGGGLVQPGNSLRLSC
AASGFTFRSFGMSWVRQAPGKEPEWVSSISGSGSDTLYADSVKGRFTISRDNAKTTL
YLQMNSLKPEDTAVYYCTIGGSLSRSSQGTQVTVSS

< , SEQ ID NO: 491"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLKPEDTAVYYCVKGSTAIVGV
PPTYPDEYDYWGQGTQVTVSSGGGGSGGGSEVQLVESGGGLVQPGGSLRLSCAASG
```

TABLE B-1-continued

Nanobodies and polypeptides against the IL-6 receptor.

FTFDDYGMSWVRQAPGRATEWVSAISWNGNNTYYTESMKGRFTISRDNAKNTVYL
QMNSLKPEDTAVYYCVKGSTAIVGVPPTYPDEYDYWGQGTQVTVSSGGGGSGGGS
AVQLVESGGGLVQPGNSLRLSCAASGFTFRSFGMSWVRQAPGKEPEWVSSISGSGSD
TLYADSVKGRFTISRDNAKTTLYLQMNSLKPEDTAVYYCTIGGSLSRSSQGTQVTVS
S

< , SEQ ID NO: 492"; PRT; ->"
EVQLVESGGGLVQPGGSLRLSCAASGFSLDYYAIGWFRQAPGKEREGVSCM
DSSSGTTSTYYSDSVKGRFTISRDDAKNTVYLQMNSLKPEDTAVYYCAADGHLNWG
QRYVPCSQISWRGWNDYWGQGTQVTVSSGGGGSGGGSEVQLVESGGGLVQPGGSL
RLSCAASGFSLDYYAIGWFRQAPGKEREGVSCMDSSSGTTSTYYSDSVKGRFTISRD
DAKNTVYLQMNSLKPEDTAVYYCAADGHLNWGQRYVPCSQISWRGWNDYWGQG
TQVTVSSGGGGSGGGSAVQLVESGGGLVQPGNSLRLSCAASGFTFRSFGMSWVRQA
PGKEPEWVSSISGSGSDTLYADSVKGRFTISRDNAKTTLYLQMNSLKPEDTAVYYCTI
GGSLSRSSQGTQVTVSS

Humanized trivalent bispecific polypeptides directed against the IL-6 receptor and human serum albumin < , SEQ ID NO: 493"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSSGGGGSGGGSEVQLVESGGGLVQPGGSLRLSCAA
SGSIFKVNAMGWYRQAPGKGRELVAGIISGGSTNYADSVKGRLTISRDNAKNTVYL
QMNSLRPEDTAVYYCSFVTTNSDYDLGRDYWGQGTLVTVSS < , SEQ ID NO: 494"; PRT; ->"
EVQLVESGGGLVQPGGSLRLSCAASGSIFKVNAMGWYRQAPGKGRELVAGII
SGGSTNYADSVKGRFTISRDNAKNTVYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSSGGGGSGGGSEVQLVESGGGLVQPGGSLRLSCAA
SGSIFKVNAMGWYRQAPGKGRELVAGIISGGSTNYADSVKGRFTISRDNAKNTVYL
QMNSLRPEDTAVYYCSFVTTNSDYDLGRDYWGQGTLVTVSS < , SEQ ID NO: 495"; PRT; ->"
EVQLVESGGGLVQPGGSLRLSCAASGSIFKVNAMGWYRQAPGKGRELVAGII
SGGSTNYADSVKGRLTISRDNAKNTLYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSSGGGGSGGGSEVQLVESGGGLVQPGGSLRLSCAA
SGSIFKVNAMGWYRQAPGKGRELVAGIISGGSTNYADSVKGRLTISRDNAKNTLYLQ
MNSLRPEDTAVYYCSFVTTNSDYDLGRDYWGQGTLVTVSS < , SEQ ID NO: 496"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCAFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSSGGGGSGGGSEVQLVESGGGLVQPGGSLRLSCAA
SGSIFKVNAMGWYRQAPGKGRELVAGIISGGSTNYADSVKGRLTISRDNAKNTVYL
QMNSLRPEDTAVYYCAFVTTNSDYDLGRDYWGQGTLVTVSS < IL6R67, SEQ ID NO: 497"; PRT; ->"
EVQLVESGGGLVQPGGSLRLSCAASGSIFKVNAMGWYRQAPGKGRELVAGII
SGGSTNYADSVKGRFTISRDNAKNTLYLQMNSLRPEDTAVYYCAFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSSGGGGSGGGSEVQLVESGGGLVQPGGSLRLSCAA
SGSIFKVNAMGWYRQAPGKGRELVAGIISGGSTNYADSVKGRFTISRDNAKNTLYLQ
MNSLRPEDTAVYYCAFVTTNSDYDLGRDYWGQGTLVTVSS < , SEQ ID NO: 498"; PRT; ->"
EVQLVESGGGLVQPGGSLRLSCAASGFTFDDYDIGWFRQAPGKGREGVSGIS
SSDGNTYYADSVKGRFTISSDNAKNTVYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWVSSISGSGSDTLYADSVKGRFTISRDNAKTTLYLQMNSL
RPEDTAVYYCTIGGSLSRSSQGTLVTVSSGGGGSGGGSEVQLVESGGGLVQPGGSLR
LSCAASGFTFDDYDIGWFRQAPGKGREGVSGISSSDGNTYYADSVKGRFTISSDNAK
NTVYLQMNSLRPEDTAVYYCAAEPPDSSWYLDGSPEFFKYWGQGTLVTVSS < , SEQ ID NO: 499"; PRT; ->"
EVQLVESGGGLVQPGGSLRLSCAASGFTFSDYDIGWFRQAPGKGREGVSGISS
SDGNTYYADSVKGRFTISSDNAKNTVYLQMNSLRPEDTAVYYCAAEPPDSSWYLDG
SPEFFKYWGQGTLVTVSSGGGGSGGGSEVQLVESGGGLVQPGNSLRLSCAASGFTFS
SFGMSWVRQAPGKGLEWVSSISGSGSDTLYADSVKGRFTISRDNAKTTLYLQMNSL TABLE B-1-continued Nanobodies and polypeptides against the IL-6 receptor.

```
RPEDTAVYYCTIGGSLSRSSQGTLVTVSSGGGGSGGGSEVQLVESGGGLVQPGGSLR
LSCAASGFTFSDYDIGWFRQAPGKGREGVSGISSSDGNTYYADSVKGRFTISSDNAK
NTVYLQMNSLRPEDTAVYYCAAEPPDSSWYLDGSPEFFKYWGQGTLVTVSS

<  , SEQ ID NO: 500"; PRT; ->"
EVQLVESGGGLVQPGGSLRLSCAASGFTFDDYDIGWFRQAPGKGREGVSGIS
SSDGNTYYADSVKGRFTISRDNAKNTVYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWVSSISGSGSDTLYADSVKGRFTISRDNAKTTLYLQMNSL
RPEDTAVYYCTIGGSLSRSSQGTLVTVSSGGGGSGGGSEVQLVESGGGLVQPGGSLR
LSCAASGFTFDDYDIGWFRQAPGKGREGVSGISSSDGNTYYADSVKGRFTISRDNAK
NTVYLQMNSLRPEDTAVYYCAAEPPDSSWYLDGSPEFFKYWGQGTLVTVSS

<  , SEQ ID NO: 501"; PRT; ->"
EVQLVESGGGLVQPGGSLRLSCAASGFTFDDYDIGWFRQAPGKGREGVSGIS
SSDGNTYYADSVKGRFTISSDNAKNTVYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWYSSISGSGSDTLYADSVKGRFTISRDNAKTTLYLQMNSL
RPEDTAVYYCTIGGSLSRSSQGTLVTVSSGGGGSGGGSEVQLVESGGGLVQPGGSLR
LSCAASGFTFDDYDIGWFRQAPGKGREGVSGISSSDGNTYYADSVKGRFTISSDNAK
NTLYLQMNSLRPEDTAVYYCAAEPPDSSWYLDGSPEFFKYWGQGTLVTVSS

<  IL6R203, SEQ ID NO: 502"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSGGGGSGGGSEVQLVESGGGLVQPGNSLRLSCAASGFTFS
SFGMSWVRQAPGKGLEWVSSISGSGSDTLYADSVKGRFTISRDNAKTTLYLQMNSL
RPEDTAVYYCTIGGSLSRSSQGTLVTVSSGGGGSGGGSEVQLVESGGGLVQPGGSLR
LSCAASGFTFSDYDIGWFRQAPGKGREGVSGISSSDGNTYYADSVKGRFTISRDNAK
NTLYLQMNSLRPEDTAVYYCAAEPPDSSWYLDGSPEFFKYWGQGTLVTVSS

<  , SEQ ID NO: 503"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGRATEWVSAISWNGNNTYYTESMKGRFTISRD
NAKNTVYLQMNSLRPEDTAVYYCVKGSTAIVGVPPTYPDEYDYWGQGTLVTVSS

<  , SEQ ID NO: 504"; PRT; ->"
EVQLVESGGGLVQPGGSLRLSCAASGFTFDDYGMSWVRQAPGKGLEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGKGLEWVSAISWNGNNTYYTESMKGRFTISRD
NAKNTVYLQMNSLRPEDTAVYYCVKGSTAIVGVPPTYPDEYDYWGQGTLVTVSS

<  , SEQ ID NO: 505"; PRT; ->"
EVQLVESGGGLVQPGGSLRLSCAASGFTFDDYGMSWVRQAPGRATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGRATEWVSAISWNGNNTYYTESMKGRFTISRD
NAKNTLYLQMNSLRPEDTAVYYCVKGSTAIVGVPPTYPDEYDYWGQGTLVTVSS

<  , SEQ ID NO: 506"; PRT; ->"
EVQLVESGGGLVQPGGSLRLSCAASGFTFDDYGMSWVRQAPGKGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGKGLEWVSAISWNGNNTYYTESMKGRFTISRD
NAKNTLYLQMNSLRPEDTAVYYCVKGSTAIVGVPPTYPDEYDYWGQGTLVTVSS

<  , SEQ ID NO: 507"; PRT; ->"
EVQLVESGGGLVQPGGSLRLSCAASGFTFDDYGMSWVRQAPGRGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGRGLEWVSAISWNGNNTYYTESMKGRFTISRD
NAKNTLYLQMNSLRPEDTAVYYCVKGSTAIVGVPPTYPDEYDYWGQGTLVTVSS
```

TABLE B-1-continued

Nanobodies and polypeptides against the IL-6 receptor.

< , SEQ ID NO: 508"; PRT; ->"
EVQLVESGGGLVQPGGSLRLSCAASGFTFDDYGMSWVRQAPGRALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGRALEWVSAISWNGNNTYYTESMKGRFTISRD
NAKNTLYLQMNSLRPEDTAVYYCVKGSTAIVGVPPTYPDEYDYWGQGTLVTVSS

< , SEQ ID NO: 509"; PRT; ->"
EVQLVESGGGLVQPGGSLRLSCAASGFTFDDYGMSWVRQAPGKATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGKATEWVSAISWNGNNTYYTESMKGRFTISRD
NAKNTLYLQMNSLRPEDTAVYYCVKGSTAIVGVPPTYPDEYDYWGQGTLVTVSS

< IL6R92, SEQ ID NO: 510"; PRT; ->"
EVQLVESGGGLVQPGGSLRLSCAASGFTFDDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGKGTEWVSAISWNGNNTYYTESMKGRFTISRD
NAKNTLYLQMNSLRPEDTAVYYCVKGSTAIVGVPPTYPDEYDYWGQGTLVTVSS

< , SEQ ID NO: 511"; PRT; ->"
EVQLVESGGGLVQPGGSLRLSCAASGFTFDDYGMSWVRQAPGRGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGRGTEWVSAISWNGNNTYYTESMKGRFTISRD
NAKNTLYLQMNSLRPEDTAVYYCVKGSTAIVGVPPTYPDEYDYWGQGTLVTVSS

< , SEQ ID NO: 512"; PRT; ->"
EVQLVESGGGLVQPGGSLRLSCAASGFTFDDYGMSWVRQAPGKALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFDDYGMSWVRQAPGKALEWVSAISWNGNNTYYTESMKGRFTISRD
NAKNTLYLQMNSLRPEDTAVYYCVKGSTAIVGVPPTYPDEYDYWGQGTLVTVSS

< , SEQ ID NO: 513"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFSDYGMSWVRQAPGKGTEWVSAISWNGNNTYYTESMKGRFTISRD
NAKNTLYLQMNSLRPEDTAVYYCVKGSTAIVGVPPTYPDEYDYWGQGTLVTVSS

< , SEQ ID NO: 514"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCAKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSSGGGGSGGGSEVQLVESGGGLVQPGGS
LRLSCAASGFTFSDYGMSWVRQAPGKGTEWVSAISWNGNNTYYTESMKGRFTISRD
NAKNTLYLQMNSLRPEDTAVYYCAKGSTAIVGVPPTYPDEYDYWGQGTLVTVSS

< , SEQ ID NO: 515"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCSFVTTNSDYDLGR
DYWGQGTLVTVSSGGGGSGGGSEVQLVESGGGLVQPGGSLRLSCAASGSIFKVNAM
GWYRQAPGKGRELVAGIISGGSTNYADSVKGRLTISRDNAKNTVYLQMNSLRPEDT
AVYYCSFVTTNSDYDLGRDYWGQGTLVTVSSGGGGSGGGSEVQLVESGGGLVQPG
NSLRLSCAASGFTFSSFGMSWVRQAPGKGLEWVSSISGSGSDTLYADSVKGRFTISR
DNAKTTLYLQMNSLRPEDTAVYYCTIGGSLSRSSQGTLVTVSS

< , SEQ ID NO: 516"; PRT; ->"
EVQLVESGGGLVQPGGSLRLSCAASGSIFKVNAMGWYRQAPGKGRELVAGII
SGGSTNYADSVKGRFTISRDNAKNTVYLQMNSLRPEDTAVYYCSFVTTNSDYDLGR
DYWGQGTLVTVSSGGGGSGGGSEVQLVESGGGLVQPGGSLRLSCAASGSIFKVNAM
GWYRQAPGKGRELVAGIISGGSTNYADSVKGRFTISRDNAKNTVYLQMNSLRPEDT

TABLE B-1-continued

Nanobodies and polypeptides against the IL-6 receptor.

AVYYCSFVTTNSDYDLGRDYWGQGTLVTVSSGGGGSGGGSEVQLVESGGGLVQPG
NSLRLSCAASGFTFSSFGMSWVRQAPGKGLEWVSSISGSGSDTLYADSVKGRFTISR
DNAKTTLYLQMNSLRPEDTAVYYCTIGGSLSRSSQGTLVTVSS

< , SEQ ID NO: 517"; PRT; ->"
EVQLVESGGGLVQPGGSLRLSCAASGSIFKVNAMGWYRQAPGKGRELVAGII
SGGSTNYADSVKGRLTISRDNAKNTLYLQMNSLRPEDTAVYYCSFVTTNSDYDLGR
DYWGQGTLVTVSSGGGGSGGGSEVQLVESGGGLVQPGGSLRLSCAASGSIFKVNAM
GWYRQAPGKGRELVAGIISGGSTNYADSVKGRLTISRDNAKNTLYLQMNSLRPEDT
AVYYCSFVTTNSDYDLGRDYWGQGTLVTVSSGGGGSGGGSEVQLVESGGGLVQPG
NSLRLSCAASGFTFSSFGMSWVRQAPGKGLEWVSSISGSGSDTLYADSVKGRFTISR
DNAKTTLYLQMNSLRPEDTAVYYCTIGGSLSRSSQGTLVTVSS

< , SEQ ID NO: 518"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCAFVTTNSDYDLGR
DYWGQGTLVTVSSGGGGSGGGSEVQLVESGGGLVQPGGSLRLSCAASGSIFKVNAM
GWYRQAPGKGRELVAGIISGGSTNYADSVKGRLTISRDNAKNTVYLQMNSLRPEDT
AVYYCAFVTTNSDYDLGRDYWGQGTLVTVSSGGGGSGGGSEVQLVESGGGLVQPG
NSLRLSCAASGFTFSSFGMSWVRQAPGKGLEWVSSISGSGSDTLYADSVKGRFTISR
DNAKTTLYLQMNSLRPEDTAVYYCTIGGSLSRSSQGTLVTVSS

< , SEQ ID NO: 519"; PRT; ->"
EVQLVESGGGLVQPGGSLRLSCAASGSIFKVNAMGWYRQAPGKGRELVAGII
SGGSTNYADSVKGRFTISRDNAKNTLYLQMNSLRPEDTAVYYCAFVTTNSDYDLGR
DYWGQGTLVTVSSGGGGSGGGSEVQLVESGGGLVQPGGSLRLSCAASGSIFKVNAM
GWYRQAPGKGRELVAGIISGGSTNYADSVKGRFTISRDNAKNTLYLQMNSLRPEDT
AVYYCAFVTTNSDYDLGRDYWGQGTLVTVSSGGGGSGGGSEVQLVESGGGLVQPG
NSLRLSCAASGFTFSSFGMSWVRQAPGKGLEWVSSISGSGSDTLYADSVKGRFTISR
DNAKTTLYLQMNSLRPEDTAVYYCTIGGSLSRSSQGTLVTVSS

< , SEQ ID NO: 520"; PRT; ->"
EVQLVESGGGLVQPGGSLRLSCAASGFTFDDYDIGWFRQAPGKGREGVSGIS
SSDGNTYYADSVKGRFTISSDNAKNTVYLQMNSLRPEDTAVYYCAAEPPDSSWYLD
GSPEFFKYWGQGTLVTVSSGGGGSGGGSEVQLVESGGGLVQPGGSLRLSCAASGFTF
DDYDIGWFRQAPGKGREGVSGISSSDGNTYYADSVKGRFTISSDNAKNTVYLQMNS
LRPEDTAVYYCAAEPPDSSWYLDGSPEFFKYWGQGTLVTVSSGGGGSGGGSEVQLV
ESGGGLVQPGNSLRLSCAASGFTFSSFGMSWVRQAPGKGLEWVSSISGSGSDTLYAD
SVKGRFTISRDNAKTTLYLQMNSLRPEDTAVYYCTIGGSLSRSSQGTLVTVSS

< , SEQ ID NO: 521"; PRT; ->"
EVQLVESGGGLVQPGGSLRLSCAASGFTFSDYDIGWFRQAPGKGREGVSGISS
SDGNTYYADSVKGRFTISSDNAKNTVYLQMNSLRPEDTAVYYCAAEPPDSSWYLDG
SPEFFKYWGQGTLVTVSSGGGGSGGGSEVQLVESGGGLVQPGGSLRLSCAASGFTFS
DYDIGWFRQAPGKGREGVSGISSSDGNTYYADSVKGRFTISSDNAKNTVYLQMNSL
RPEDTAVYYCAAEPPDSSWYLDGSPEFFKYWGQGTLVTVSSGGGGSGGGSEVQLVE
SGGGLVQPGNSLRLSCAASGFTFSSFGMSWVRQAPGKGLEWVSSISGSGSDTLYADS
VKGRFTISRDNAKTTLYLQMNSLRPEDTAVYYCTIGGSLSRSSQGTLVTVSS

< , SEQ ID NO: 522"; PRT; ->"
EVQLVESGGGLVQPGGSLRLSCAASGFTFDDYDIGWFRQAPGKGREGVSGIS
SSDGNTYYADSVKGRFTISRDNAKNTVYLQMNSLRPEDTAVYYCAAEPPDSSWYLD
GSPEFFKYWGQGTLVTVSSGGGGSGGGSEVQLVESGGGLVQPGGSLRLSCAASGFTF
DDYDIGWFRQAPGKGREGVSGISSSDGNTYYADSVKGRFTISRDNAKNTVYLQMNS
LRPEDTAVYYCAAEPPDSSWYLDGSPEFFKYWGQGTLVTVSSGGGGSGGGSEVQLV
ESGGGLVQPGNSLRLSCAASGFTFSSFGMSWVRQAPGKGLEWVSSISGSGSDTLYAD
SVKGRFTISRDNAKTTLYLQMNSLRPEDTAVYYCTIGGSLSRSSQGTLVTVSS

< , SEQ ID NO: 523"; PRT; ->"
EVQLVESGGGLVQPGGSLRLSCAASGFTFDDYDIGWFRQAPGKGREGVSGIS
SSDGNTYYADSVKGRFTISSDNAKNTLYLQMNSLRPEDTAVYYCAAEPPDSSWYLD
GSPEFFKYWGQGTLVTVSSGGGGSGGGSEVQLVESGGGLVQPGGSLRLSCAASGFTF
DDYDIGWFRQAPGKGREGVSGISSSDGNTYYADSVKGRFTISSDNAKNTLYLQMNS
LRPEDTAVYYCAAEPPDSSWYLDGSPEFFKYWGQGTLVTVSSGGGGSGGGSEVQLV
ESGGGLVQPGNSLRLSCAASGFTFSSFGMSWVRQAPGKGLEWVSSISGSGSDTLYAD
SVKGRFTISRDNAKTTLYLQMNSLRPEDTAVYYCTIGGSLSRSSQGTLVTVSS

< , SEQ ID NO: 524"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSGGGGSGGGSEVQLVESGGGLVQPGGSLRLSCAASGFTFS
DYDIGWFRQAPGKGREGVSGISSSDGNTYYADSVKGRFTISRDNAKNTLYLQMNSL
RPEDTAVYYCAAEPPDSSWYLDGSPEFFKYWGQGTLVTVSSGGGGSGGGSEVQLVE
SGGGLVQPGNSLRLSCAASGFTFSSFGMSWVRQAPGKGLEWVSSISGSGSDTLYADS
VKGRFTISRDNAKTTLYLQMNSLRPEDTAVYYCTIGGSLSRSSQGTLVTVSS

TABLE B-1-continued

Nanobodies and polypeptides against the IL-6 receptor.

< , SEQ ID NO: 525"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGRATEWVSAISWNGNNTYYTESMKGRFTISRDNAKNTVYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 526"; PRT; ->"
EVQLVESGGGLVQPGGSLRLSCAASGFTFDDYGMSWVRQAPGKGLEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGKGLEWVSAISWNGNNTYYTESMKGRFTISRDNAKNTVYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 527"; PRT; ->"
EVQLVESGGGLVQPGGSLRLSCAASGFTFDDYGMSWVRQAPGRATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGRATEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 528"; PRT; ->"
EVQLVESGGGLVQPGGSLRLSCAASGFTFDDYGMSWVRQAPGKGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGKGLEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 529"; PRT; ->"
EVQLVESGGGLVQPGGSLRLSCAASGFTFDDYGMSWVRQAPGRGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGRGLEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 530"; PRT; ->"
EVQLVESGGGLVQPGGSLRLSCAASGFTFDDYGMSWVRQAPGRALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGRALEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 531"; PRT; ->"
EVQLVESGGGLVQPGGSLRLSCAASGFTFDDYGMSWVRQAPGKATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGKATEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 532"; PRT; ->"
EVQLVESGGGLVQPGGSLRLSCAASGFTFDDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGKGTEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< , SEQ ID NO: 533"; PRT; ->"
EVQLVESGGGLVQPGGSLRLSCAASGFTFDDYGMSWVRQAPGRGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGRGTEWVSAISWNGNNTYYTESMKGRFTISRDNAKNTLYLQ

TABLE B-1-continued

Nanobodies and polypeptides against the IL-6 receptor.

```
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

<  , SEQ ID NO: 534"; PRT; ->"
EVQLVESGGGLVQPGGSLRLSCAASGFTFDDYGMSWVRQAPGKALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFDDYGMSWVRQAPGKALEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

<  , SEQ ID NO: 535"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGGSLRLSCAASGF
TFSDYGMSWVRQAPGKGTEWVSAISWNGNNTYYTESMKGRFTISRDNAKNTLYLQ
MNSLRPEDTAVYYCVKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

< SEQ ID NO: 536"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCAKGSTAIVGVP
PTYPDEYDYWGQGTLVTVSSGGGGSGGGSEVQLVESGGGLVQPGGSLRLSCAASGF
TFSDYGMSWVRQAPGKGTEWVSAISWNGNNTYYTESMKGRFTISRDNAKNTLYLQ
MNSLRPEDTAVYYCAKGSTAIVGVPPTYPDEYDYWGQGTLVTVSSGGGGSGGGSEV
QLVESGGGLVQPGNSLRLSCAASGFTFSSFGMSWVRQAPGKGLEWVSSISGSGSDTL
YADSVKGRFTISRDNAKTTLYLQMNSLRPEDTAVYYCTIGGSLSRSSQGTLVTVSS

<  , SEQ ID NO: 537"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTVYLQMNSLRPEDTAVYYCSFV
TTNSDYDLGRDYWGQGTLVTVSSGGGGSGGGSEVQLVESGGGLVQPGGSLRLSCA
ASGSIFKVNAMGWYRQAPGKGRELVAGIISGGSTNYADSVKGRLTISRDNAKNTVY
LQMNSLRPEDTAVYYCSFVTTNSDYDLGRDYWGQGTLVTVSS

<  , SEQ ID NO: 538"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRFTISRDNAKNTVYLQMNSLRPEDTAVYYCSFV
TTNSDYDLGRDYWGQGTLVTVSSGGGGSGGGSEVQLVESGGGLVQPGGSLRLSCA
ASGSIFKVNAMGWYRQAPGKGRELVAGIISGGSTNYADSVKGRFTISRDNAKNTVY
LQMNSLRPEDTAVYYCSFVTTNSDYDLGRDYWGQGTLVTVSS

<  , SEQ ID NO: 539"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTLYLQMNSLRPEDTAVYYCSFV
TTNSDYDLGRDYWGQGTLVTVSSGGGGSGGGSEVQLVESGGGLVQPGGSLRLSCA
ASGSIFKVNAMGWYRQAPGKGRELVAGIISGGSTNYADSVKGRLTISRDNAKNTLYL
QMNSLRPEDTAVYYCSFVTTNSDYDLGRDYWGQGTLVTVSS

<  , SEQ ID NO: 540"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTVYLQMNSLRPEDTAVYYCAF
VTTNSDYDLGRDYWGQGTLVTVSSGGGGSGGGSEVQLVESGGGLVQPGGSLRLSC
AASGSIFKVNAMGWYRQAPGKGRELVAGIISGGSTNYADSVKGRLTISRDNAKNTV
YLQMNSLRPEDTAVYYCAFVTTNSDYDLGRDYWGQGTLVTVSS

<  , SEQ ID NO: 541"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRFTISRDNAKNTLYLQMNSLRPEDTAVYYCAFV
TTNSDYDLGRDYWGQGTLVTVSSGGGGSGGGSEVQLVESGGGLVQPGGSLRLSCA
ASGSIFKVNAMGWYRQAPGKGRELVAGIISGGSTNYADSVKGRFTISRDNAKNTLYL
QMNSLRPEDTAVYYCAFVTTNSDYDLGRDYWGQGTLVTVSS
```

TABLE B-1-continued

Nanobodies and polypeptides against the IL-6 receptor.

< SEQ ID NO: 542"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISSDNAKNTVYLQMNSLRPEDTAVYYCA
AEPPDSSWYLDGSPEFFKYWGQGTLVTVSSGGGGSGGGSEVQLVESGGGLVQPGGS
LRLSCAASGFTFDDYDIGWFRQAPGKGREGVSGISSSDGNTYYADSVKGRFTISSDN
AKNTVYLQMNSLRPEDTAVYYCAAEPPDSSWYLDGSPEFFKYWGQGTLVTVSS

< , SEQ ID NO: 543"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYDIGWFRQAPG
KGREGVSGISSSDGNTYYADSVKGRFTISSDNAKNTVYLQMNSLRPEDTAVYYCAA
EPPDSSWYLDGSPEFFKYWGQGTLVTVSSGGGGSGGGSEVQLVESGGGLVQPGGSL
RLSCAASGFTFSDYDIGWFRQAPGKGREGVSGISSSDGNTYYADSVKGRFTISSDNA
KNTVYLQMNSLRPEDTAVYYCAAEPPDSSWYLDGSPEFFKYWGQGTLVTVSS

< , SEQ ID NO: 544"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISRDNAKNTVYLQMNSLRPEDTAVYYCA
AEPPDSSWYLDGSPEFFKYWGQGTLVTVSSGGGGSGGGSEVQLVESGGGLVQPGGS
LRLSCAASGFTFDDYDIGWFRQAPGKGREGVSGISSSDGNTYYADSVKGRFTISRDN
AKNTVYLQMNSLRPEDTAVYYCAAEPPDSSWYLDGSPEFFKYWGQGTLVTVSS

< , SEQ ID NO: 545"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISSDNAKNTLYLQMNSLRPEDTAVYYCA
AEPPDSSWYLDGSPEFFKYWGQGTLVTVSSGGGGSGGGSEVQLVESGGGLVQPGGS
LRLSCAASGFTFDDYDIGWFRQAPGKGREGVSGISSSDGNTYYADSVKGRFTISSDN
AKNTLYLQMNSLRPEDTAVYYCAAEPPDSSWYLDGSPEFFKYWGQGTLVTVSS

< , SEQ ID NO: 546"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYDIGWFRQAPG
KGREGVSGISSSDGNTYYADSVKGRFTISRDNAKNTLYLQMNSLRPEDTAVYYCAA
EPPDSSWYLDGSPEFFKYWGQGTLVTVSSGGGGSGGGSEVQLVESGGGLVQPGGSL
RLSCAASGFTFSDYDIGWFRQAPGKGREGVSGISSSDGNTYYADSVKGRFTISRDNA
KNTLYLQMNSLRPEDTAVYYCAAEPPDSSWYLDGSPEFFKYWGQGTLVTVSS

< , SEQ ID NO: 547"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRATEWVSAISWNGNNTYYTESMKGRFTISRDNAKNTVYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGRATEWVSAISWNGNNTYYTESMKGRFTISR
DNAKNTVYLQMNSLRPEDTAVYYCVKGSTAIVGVPPTYPDEYDYWGQGTLVTVSS

< , SEQ ID NO: 548"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGLEWVSAISWNGNNTYYTESMKGRFTISRDNAKNTVYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGKGLEWVSAISWNGNNTYYTESMKGRFTISR
DNAKNTVYLQMNSLRPEDTAVYYCVKGSTAIVGVPPTYPDEYDYWGQGTLVTVSS

< , SEQ ID NO: 549"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRATEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGRATEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 550"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGLEWVSAISWNGNNTYYTESMKGRFTISRDNAKNTLYLQMNSLRPEDTAVYYC

TABLE B-1-continued

Nanobodies and polypeptides against the IL-6 receptor.

VKGSTAIVGVPPTYPDEYDYWGQGTLVTVSSGGGGSGGGSEVQLVESGGGLVQPGG
SLRLSCAASGFTFDDYGMSWVRQAPGKGLEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 551"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRGLEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGRGLEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 552"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRALEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGRALEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 553"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKATEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGKATEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 554"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGTEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGKGTEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 555"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRGTEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGRGTEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 556"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKALEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFDDYGMSWVRQAPGKALEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 557"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYGMSWVRQAP
GKGTEWVSAISWNGNNTYYTESMKGRFTISRDNAKNTLYLQMNSLRPEDTAVYYC
VKGSTAIVGVPPTYPDEYDYWGQGTLVTVSSGGGGSGGGSEVQLVESGGGLVQPGG
SLRLSCAASGFTFSDYGMSWVRQAPGKGTEWVSAISWNGNNTYYTESMKGRFTISR
DNAKNTLYLQMNSLRPEDTAVYYCVKGSTAIVGVPPTYPDEYDYWGQGTLVTVSS

< , SEQ ID NO: 558"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYGMSWVRQAP
GKGTEWVSAISWNGNNTYYTESMKGRFTISRDNAKNTLYLQMNSLRPEDTAVYYC
AKGSTAIVGVPPTYPDEYDYWGQGTLVTVSSGGGGSGGGSEVQLVESGGGLVQPGG
SLRLSCAASGFTFSDYGMSWVRQAPGKGTEWVSAISWNGNNTYYTESMKGRFTISR
DNAKNTLYLQMNSLRPEDTAVYYCAKGSTAIVGVPPTYPDEYDYWGQGTLVTVSS

TABLE B-1-continued

Nanobodies and polypeptides against the IL-6 receptor.

Humanized bispecific polypeptides against the IL6 receptor and human serum albumin < , SEQ ID NO: 559"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSS < , SEQ ID NO: 560"; PRT; ->"
EVQLVESGGGLVQPGGSLRLSCAASGSIFKVNAMGWYRQAPGKGRELVAGII
SGGSTNYADSVKGRFTISRDNAKNTVYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSS < , SEQ ID NO: 561"; PRT; ->"
EVQLVESGGGLVQPGGSLRLSCAASGSIFKVNAMGWYRQAPGKGRELVAGII
SGGSTNYADSVKGRLTISRDNAKNTLYLQMNSLRPEDTAVYYCSFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSS < , SEQ ID NO: 562"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCAFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSS < IL6R66, SEQ ID NO: 563"; PRT; ->"
EVQLVESGGGLVQPGGSLRLSCAASGSIFKVNAMGWYRQAPGKGRELVAGII
SGGSTNYADSVKGRFTISRDNAKNTLYLQMNSLRPEDTAVYYCAFVTTNSDYDLGR
DYWGQGTLVTVSSGGGGSGGGSEVQLVESGGGLVQPGNSLRLSCAASGFTFSSFGM
SWVRQAPGKGLEWVSSISGSGSDTLYADSVKGRFTISRDNAKTTLYLQMNSLRPEDT
AVYYCTIGGSLSRSSQGTLVTVSS < , SEQ ID NO: 564"; PRT; ->"
EVQLVESGGGLVQPGGSLRLSCAASGFTFDDYDIGWFRQAPGKGREGVSGIS
SSDGNTYYADSVKGRFTISSDNAKNTVYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWVSSISGSGSDTLYADSVKGRFTISRDNAKTTLYLQMNSL
RPEDTAVYYCTIGGSLSRSSQGTLVTVSS < , SEQ ID NO: 565"; PRT; ->"
EVQLVESGGGLVQPGGSLRLSCAASGFTFSDYDIGWFRQAPGKGREGVSGISS
SDGNTYYADSVKGRFTISSDNAKNTVYLQMNSLRPEDTAVYYCAAEPPDSSWYLDG
SPEFFKYWGQGTLVTVSSGGGGSGGGSEVQLVESGGGLVQPGNSLRLSCAASGFTFS
SFGMSWVRQAPGKGLEWVSSISGSGSDTLYADSVKGRFTISRDNAKTTLYLQMNSL
RPEDTAVYYCTIGGSLSRSSQGTLVTVSS < , SEQ ID NO: 566"; PRT; ->"
EVQLVESGGGLVQPGGSLRLSCAASGFTFDDYDIGWFRQAPGKGREGVSGIS
SSDGNTYYADSVKGRFTISRDNAKNTVYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWVSSISGSGSDTLYADSVKGRFTISRDNAKTTLYLQMNSL
RPEDTAVYYCTIGGSLSRSSQGTLVTVSS < , SEQ ID NO: 567"; PRT; ->"
EVQLVESGGGLVQPGGSLRLSCAASGFTFDDYDIGWFRQAPGKGREGVSGIS
SSDGNTYYADSVKGRFTISSDNAKNTLYLQMNSLRPEDTAVYYCAAEPPDSSWYLD
GSPEFFKYWGQGTLVTVSSGGGGSGGGSEVQLVESGGGLVQPGNSLRLSCAASGFTF
SSFGMSWVRQAPGKGLEWVSSISGSGSDTLYADSVKGRFTISRDNAKTTLYLQMNSL
RPEDTAVYYCTIGGSLSRSSQGTLVTVSS < IL6R202, SEQ ID NO: 568"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSGGGGSGGGSEVQLVESGGGLVQPGNSLRLSCAASGFTFS
SFGMSWVRQAPGKGLEWVSSISGSGSDTLYADSVKGRFTISRDNAKTTLYLQMNSL
RPEDTAVYYCTIGGSLSRSSQGTLVTVSS TABLE B-1-continued Nanobodies and polypeptides against the IL-6 receptor.

< , SEQ ID NO: 569"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 570"; PRT; ->"
EVQLVESGGGLVQPGGSLRLSCAASGFTFDDYGMSWVRQAPGKGLEWVSAI
SWNGNNTYYTESMKGRFTISRDNAKNTVYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 571"; PRT; ->"
EVQLVESGGGLVQPGGSLRLSCAASGETFDDYGMSWVRQAPGRATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 572"; PRT; ->"
EVQLVESGGGLVQPGGSLRLSCAASGFTFDDYGMSWVRQAPGKGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 573"; PRT; ->"
EVQLVESGGGLVQPGGSLRLSCAASGFTFDDYGMSWVRQAPGRGLEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 574"; PRT; ->"
EVQLVESGGGLVQPGGSLRLSCAASGFTFDDYGMSWVRQAPGRALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 575"; PRT; ->"
EVQLVESGGGLVQPGGSLRLSCAASGFTFDDYGMSWVRQAPGKATEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< IL6R91, SEQ ID NO: 576"; PRT; ->"
EVQLVESGGGLVQPGGSLRLSCAASGFTFDDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 577"; PRT; ->"
EVQLVESGGGLVQPGGSLRLSCAASGFTFDDYGMSWVRQAPGRGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 578"; PRT; ->"
EVQLVESGGGLVQPGGSLRLSCAASGFTFDDYGMSWVRQAPGKALEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 579"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

TABLE B-1-continued

Nanobodies and polypeptides against the IL-6 receptor.

```
< , SEQ ID NO: 580"; PRT; ->"
EVQLVESGGGLVQPGGSLRLSCAASGFTFSDYGMSWVRQAPGKGTEWVSAI
SWNGNNTYYTESMKGRFTISRDNAKNTLYLQMNSLRPEDTAVYYCAKGSTAIVGVP
PTYPDEYDYWGQGTLVTVSSGGGGSGGGSEVQLVESGGGLVQPGNSLRLSCAASGF
TFSSFGMSWVRQAPGKGLEWVSSISGSGSDTLYADSVKGRFTISRDNAKTTLYLQMN
SLRPEDTAVYYCTIGGSLSRSSQGTLVTVSS

< , SEQ ID NO: 581"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTVYLQMNSLRPEDTAVYYCSFV
TTNSDYDLGRDYWGQGTLVTVSS

< , SEQ ID NO: 582"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRFTISRDNAKNTVYLQMNSLRPEDTAVYYCSFV
TTNSDYDLGRDYWGQGTLVTVSS

< , SEQ ID NO: 583"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTVYLQMNSLRPEDTAVYYCSFV
TTNSDYDLGRDYWGQGTLVTVSS

< , SEQ ID NO: 584"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRLTISRDNAKNTVYLQMNSLRPEDTAVYYCAF
VTTNSDYDLGRDYWGQGTLVTVSS

< , SEQ ID NO: 585"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGSIFKVNAMGWYRQAP
GKGRELVAGIISGGSTNYADSVKGRFTISRDNAKNTVYLQMNSLRPEDTAVYYCAFV
TTNSDYDLGRDYWGQGTLVTVSS

< , SEQ ID NO: 586"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISSDNAKNTVYLQMNSLRPEDTAVYYCA
AEPPDSSWYLDGSPEFFKYWGQGTLVTVSS

< , SEQ ID NO: 587"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYDIGWFRQAPG
KGREGVSGISSSDGNTYYADSVKGRFTISSDNAKNTVYLQMNSLRPEDTAVYYCAA
EPPDSSWYLDGSPEFFKYWGQGTLVTVSS

< , SEQ ID NO: 588"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISRDNAKNTVYLQMNSLRPEDTAVYYCA
AEPPDSSWYLDGSPEFFKYWGQGTLVTVSS

< , SEQ ID NO: 589"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYDIGWFRQAP
GKGREGVSGISSSDGNTYYADSVKGRFTISSDNAKNTLYLQMNSLRPEDTAVYYCA
AEPPDSSWYLDGSPEFFKYWGQGTLVTVSS

< , SEQ ID NO: 590"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYDIGWFRQAPG
KGREGVSGISSSDGNTYYADSVKGRFTISRDNAKNTLYLQMNSLRPEDTAVYYCAA
EPPDSSWYLDGSPEFFKYWGQGTLVTVSS
```

TABLE B-1-continued

Nanobodies and polypeptides against the IL-6 receptor.

<  , SEQ ID NO: 591"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRATEWVSAISWNGNNTYYTESMKGRFTISRDNAKNTVYLQMNSLRPEDTAVYYC
VKGSTAIVGVPPTYPDEYDYWGQGTLVTVSS

<  , SEQ ID NO: 592"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGLEWVSAISWNGNNTYYTESMKGRFTISRDNAKNTVYLQMNSLRPEDTAVYYC
VKGSTAIVGVPPTYPDEYDYWGQGTLVTVSS

<  , SEQ ID NO: 593"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRATEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 594"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGLEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 595"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRGLEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 596"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRALEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 597"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKATEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 598"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKGTEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 599"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GRGTEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 600"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFDDYGMSWVRQAP
GKALEWVSAISWNGNNTYYTESMKGRFTISRDNAKNTLYLQMNSLRPEDTAVYYC
VKGSTAIVGVPPTYPDEYDYWGQGTLVTVSS

<  , SEQ ID NO: 601"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYGMSWVRQAP
GKGTEWVSAISWNGNNTYYTESMKGRFTISRDNAKNTLYLQMNSLRPEDTAVYYG
VKGSTAIVGVPPTYPDEYDYWGQGTLVTVSS

TABLE B-1-continued

Nanobodies and polypeptides against the IL-6 receptor.

< , SEQ ID NO: 602"; PRT; ->"
EVQLVESGGGLVQPGNSLRLSCAASGFTFSSFGMSWVRQAPGKGLEWVSSIS
GSGSDTLYADSVKGRFTISRDNAKTTLYLQMNSLRPEDTAVYYCTIGGSLSRSSQGT
LVTVSSGGGGSGGGSEVQLVESGGGLVQPGGSLRLSCAASGFTFSDYGMSWVRQAP
GKGTEWVSAISWNGNNTYYTESMKGRFTISRDNAKNTLYLQMNSLRPEDTAVYYC
AKGSTAIVGVPPTYPDEYDYWGQGTLVTVSS

Anti-IL-6 receptor Nanobody-human serum albumin fusion proteins

< HSA-(GGS)4GG-IL6R04, SEQ ID NO: 603"; PRT; ->"
DAHKSEVAHRFKDLGEENFKALVLIAFAQYLQQCPFEDHVKLVNEVTEFAKT
CVADESAENCDKSLHTLFGDKLCTVATLRETYGEMADCCAKQEPERNECFLQHKDD
NPNLPRLVRPEVDVMCTAFHDNEETFLKKYLYEIARRHPYFYAPELLFFAKRYKAAF
TECCQAADKAACLLPKLDELRDEGKASSAKQRLKCASLQKFGERAFKAWAVARLS
QRFPKAEFAEVSKLVTDLTKVHTECCHGDLLECADDRADLAKYICENQDSISSKLKE
CCEKPLLEKSHCIAEVENDEMPADLPSLAADFVESKDVCKNYAEAKDVFLGMFLYE
YARRHPDYSVVLLLRLAKTYETTLEKCCAAADPHECYAKVFDEFKPLVEEPQNLIKQ
NCELFEQLGEYKFQNALLVRYTKKVPQVSTPTLVEVSRNLGKVGSKCCKHPEAKRM
PCAEDYLSVVLNQLCVLHEKTPVSDRVTKCCTESLVNRRPCFSALEVDETYVPKEFN
AETFTFHADICTLSEKERQIKKQTALVELVKHKPKATKEQLKAVMDDFAAFVEKCC
KADDKETCFAEEGKKLVAASQAALGLGGSGGSGGSGGEVQLVESGGGLVQAG
GSLRLSCAASGFTFDDYDIGWFRQAPGKEREGVSGISSSDGNTYYADSVKGRFTISSD
NAKNTVYLQMNSLKPEDTAVYYCAAEPPDSSWYLDGSPEFFKYWGQGTQVTVSS

< IL6R04-HSA, SEQ ID NO: 604"; PRT; ->"
EVQLVESGGGLVQAGGSLRLSCAASGFTFDDYDIGWFRQAPGKEREGVSGIS
SSDGNTYYADSVKGRFTISSDNAKNTVYLQMNSLKPEDTAVYYCAAEPPDSSWYLD
GSPEFFKYWGQGTQVTVSSDAHKSEVAHRFKDLGEENFKALVLIAFAQYLQQCPFE
DHVKLVNEVTEFAKTCVADESAENCDKSLHTLFGDKLCTVATLRETYGEMADCCA
KQEPERNECFLQHKDDNPNLPRLVRPEVDVMCTAFHDNEETFLKKYLYEIARRHPYF
YAPELLFFAKRYKAAFTECCQAADKAACLLPKLDELRDEGKASSAKQRLKCASLQK
FGERAFKAWAVARLSQRFPKAEFAEVSKLVTDLTKVHTECCHGDLLECADDRADLA
KYICENQDSISSKLKECCEKPLLEKSHCIAEVENDEMPADLPSLAADFVESKDVCKNY
AEAKDVFLGMFLYEYARRHPDYSVVLLLRLAKTYETTLEKCCAAADPHECYAKVF
DEFKPLVEEPQNLIKQNCELFEQLGEYKFQNALLVRYTKKVPQVSTPTLVEVSRNLG
KVGSKCCKHPEAKRMPCAEDYLSVVLNQLCVLHEKTPVSDRVTKCCTESLVNRRPC
FSALEVDETYVPKEFNAETFTFHADICTLSEKERQIKKQTALVELVKHKPKATKEQLK
AVMDDFAAFVEKCCKADDKETCFAEEGKKLVAASQAALGL

< IL6R201-HSA, SEQ ID NO: 605"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSDAHKSEVAHRFKDLGEENFKALVLIAFAQYLQQCPFEDH
VKLVNEVTEFAKTCVADESAENCDKSLHTLFGDKLCTVATLRETYGEMADCCAKQ
EPERNECFLQHKDDNPNLPRLVRPEVDVMCTAFHDNEETFLKKYLYEIARRHPYFYA
PELLFFAKRYKAAFTECCQAADKAACLLPKLDELRDEGKASSAKQRLKCASLQKFG
ERAFKAWAVARLSQRFPKAEFAEVSKLVTDLTKVHTECCHGDLLECADDRADLAK
YICENQDSISSKLKECCEKPLLEKSHCIAEVENDEMPADLPSLAADFVESKDVCKNYA
EAKDVFLGMFLYEYARRHPDYSVVLLLRLAKTYETTLEKCCAAADPHECYAKVFDE
FKPLVEEPQNLIKQNCELFEQLGEYKFQNALLVRYTKKVPQVSTPTLVEVSRNLGKV
GSKCCKHPEAKRMPCAEDYLSVVLNQLCVLHEKTPVSDRVTKCCTESLVNRRPCFS
ALEVDETYVPKEFNAETFTFHADICTLSEKERQIKKQTALVELVKHKPKATKEQLKA
VMDDFAAFVEKCCKADDKETCFAEEGKKLVAASQAALGL

< IL6R201-9GS-IL6R201-HSA, SEQ ID NO: 606"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSGGGGSGGGSEVQLVESGGGLVQPGGSLRLSCAASGFTFS
DYDIGWFRQAPGKGREGVSGISSSDGNTYYADSVKGRFTISRDNAKNTLYLQMNSL
RPEDTAVYYCAAEPPDSSWYLDGSPEFFKYWGQGTLVTVSSDAHKSEVAHRFKDLG
EENFKALVLIAFAQYLQQCPFEDHVKLVNEVTEFAKTCVADESAENCDKSLHTLFGD
KLCTVATLRETYGEMADCCAKQEPERNECFLQHKDDNPNLPRLVRPEVDVMCTAF
HDNEETFLKKYLYEIARRHPYFYAPELLFFAKRYKAAFTECCQAADKAACLLPKLDE
LRDEGKASSAKQRLKCASLQKFGERAFKAWAVARLSQRFPKAEFAEVSKLVTDLTK
VHTECCHGDLLECADDRADLAKYICENQDSISSKLKECCEKPLLEKSHCIAEVENDE
MPADLPSLAADFVESKDVCKNYAEAKDVFLGMFLYEYARRHPDYSVVLLLRLAKT
YETTLEKCCAAADPHECYAKVFDEFKPLVEEPQNLIKQNCELFEQLGEYKFQNALLV
RYTKKVPQVSTPTLVEVSRNLGKVGSKCCKHPEAKRMPCAEDYLSVVLNQLCVLHE
KTPVSDRVTKCCTESLVNRRPCFSALEVDETYVPKEFNAETFTFHADICTLSEKERQI
KKQTALVELVKHKPKATKEQLKAVMDDFAAFVEKCCKADDKETCFAEEGKKLVA
ASQAALGL

< IL6R201-20GS-IL6R201-HSA, SEQ ID NO: 607"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSGGGGSGGGGSGGGGSGGGGSEVQLVESGGGLVQPGGSL
RLSCAASGFTFSDYDIGWFRQAPGKGREGVSGISSSDGNTYYADSVKGRFTISRDNA
KNTLYLQMNSLRPEDTAVYYCAAEPPDSSWYLDGSPEFFKYWGQGTLVTVSSDAH

TABLE B-1-continued

Nanobodies and polypeptides against the IL-6 receptor.

KSEVAHRFKDLGEENFKALVLIAFAQYLQQCPFEDHVKLVNEVTEFAKTCVADESA
ENCDKSLHTLFGDKLCTVATLRETYGEMADCCAKQEPERNECFLQHKDDNPNLPRL
VRPEVDVMCTAFHDNEETFLKKYLYEIARRHPYFYAPELLFFAKRYKAAFTECCQA
ADKAACLLPKLDELRDEGKASSAKQRLKCASLQKFGERAFKAWAVARLSQRFPKAE
FAEVSKLVTDLTKVHTECCHGDLLECADDRADLAKYICENQDSISSKLKECCEKPLL
EKSHCIAEVENDEMPADLPSLAADFVESKDVCKNYAEAKDVFLGMFLYEYARRHPD
YSVVLLLRLAKTYETTLEKCCAAADPHECYAKVFDEFKPLVEEPQNLIKQNCELFEQ
LGEYKFQNALLVRYTKKVPQVSTPTLVEVSRNLGKVGSKCCKHPEAKRMPCAEDYL
SVVLNQLCVLHEKTPVSDRVTKCCTESLVNRRPCFSALEVDETYVPKEFNAETFTFH
ADICTLSEKERQIKKQTALVELVKHKPKATKEQLKAVMDDFAAFVEKCCKADDKET
CFAEEGKKLV

< IL6R201-AAA-IL6R201-HSA, SEQ ID NO: 608"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSSAAAEVQLVESGGGLVQPGGSLRLSCAASGFTFSDYDIGW
FRQAPGKGREGVSGISSSDGNTYYADSVKGRFTISRDNAKNTLYLQMNSLRPEDTAV
YYCAAEPPDSSWYLDGSPEFFKYWGQGTLVTVSSDAHKSEVAHRFKDLGEENFKAL
VLIAFAQYLQQCPFEDHVKLVNEVTEFAKTCVADESAENCDKSLHTLFGDKLCTVA
TLRETYGEMADCCAKQEPERNECFLQHKDDNPNLPRLVRPEVDVMCTAFHDNEETF
LKKYLYEIARRHPYFYAPELLFFAKRYKAAFTECCQAADKAACLLPKLDELRDEGK
ASSAKQRLKCASLQKFGERAFKAWAVARLSQRFPKAEFAEVSKLVTDLTKVHTECC
HGDLLECADDRADLAKYICENQDSISSKLKECCEKPLLEKSHCIAEVENDEMPADLPS
LAADFVESKDVCKNYAEAKDVFLGMFLYEYARRHPDYSVVLLLRLAKTYETTLEKC
CAAADPHECYAKVFDEFKPLVEEPQNLIKQNCELFEQLGEYKFQNALLVRYTKKVP
QVSTPTLVEVSRNLGKVGSKCCKHPEAKRMPCAEDYLSVVLNQLCVLHEKTPVSDR
VTKCCTESLVNRRPCFSALEVDETYVPKEFNAETFTFHADICTLSEKERQIKKQTALV
ELVKHKPKATKEQLKAVMDDFAAFVEKCCKADDKETCFAEEGKKLVAASQAALGL

< IL6R61, SEQ ID NO: 609"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCSFVTTNSDYDLGR
DYWGQGTLVTVSS

< IL6R62, SEQ ID NO: 610"; PRT; ->"
EVQLVESGGGLVQPGGSLRLSCAASGSIFKVNAMGWYRQAPGKGRELVAGII
SGGSTNYADSVKGRFTISRDNAKNTVYLQMNSLRPEDTAVYYCSFVTTNSDYDLGR
DYWGQGTLVTVSS

< IL6R63, SEQ ID NO: 611"; PRT; ->"
EVQLVESGGGLVQPGGSLRLSCAASGSIFKVNAMGWYRQAPGKGRELVAGII
SGGSTNYADSVKGRLTISRDNAKNTLYLQMNSLRPEDTAVYYCSFVTTNSDYDLGR
DYWGQGTLVTVSS

< IL6R64, SEQ ID NO: 612"; PRT; ->"
EVQLVESGGGLVQPGGSLRLSCAASGSIFKVNAMGWYRQAPGKGRELVAGII
SGGSTNYADSVKGRLTISRDNAKNTVYLQMNSLRPEDTAVYYCAFVTTNSDYDLGR
DYWGQGTLVTVSS

< IL6R65, SEQ ID NO: 613"; PRT; ->"
EVQLVESGGGLVQPGGSLRLSCAASGSIFKVNAMGWYRQAPGKGRELVAGII
SGGSTNYADSVKGRFTISRDNAKNTLYLQMNSLRPEDTAVYYCAFVTTNSDYDLGR
DYWGQGTLVTVSS

< IL6R71, SEQ ID NO: 614"; PRT; ->"
EVQLVESGGGLVQPGGSLRLSCAASGFTFDDYDIGWFRQAPGKGREGVSGIS
SSDGNTYYADSVKGRFTISSDNAKNTVYLQMNSLRPEDTAVYYCAAEPPDSSWYLD
GSPEFFKYWGQGTLVTVSS

< IL6R72, SEQ ID NO: 615"; PRT; ->"
EVQLVESGGGLVQPGGSLRLSCAASGFTFSDYDIGWFRQAPGKGREGVSGISS
SDGNTYYADSVKGRFTISSDNAKNTVYLQMNSLRPEDTAVYYCAAEPPDSSWYLDG
SPEFFKYWGQGTLVTVSS

< IL6R73, SEQ ID NO: 616"; PRT; ->"
EVQLVESGGGLVQPGGSLRLSCAASGFTFDDYDIGWFRQAPGKGREGVSGIS
SSDGNTYYADSVKGRFTISRDNAKNTVYLQMNSLRPEDTAVYYCAAEPPDSSWYLD
GSPEFFKYWGQGTLVTVSS

< IL6R74, SEQ ID NO: 617"; PRT; ->"
EVQLVESGGGLVQPGGSLRLSCAASGFTFDDYDIGWFRQAPGKGREGVSGIS
SSDGNTYYADSVKGRFTISSDNAKNTLYLQMNSLRPEDTAVYYCAAEPPDSSWYLD
GSPEFFKYWGQGTLVTVSS

< IL6R75, SEQ ID NO: 618"; PRT; ->"
EVQLVESGGGLVQPGGSLRLSCAASGFTFSDYDIGWFRQAPGKGREGVSGISS
SDGNTYYADSVKGRFTISRDNAKNTLYLQMNSLRPEDTAVYYCAAEPPDSSWYLDG
SPEFFKYWGQGTLVTVSS

TABLE B-1-continued

Nanobodies and polypeptides against the IL-6 receptor.

< IL6R81, SEQ ID NO: 619"; PRT; ->"
EVQLVESGGGLVQPGGSLRLSCAASGFTFDDYGMSWVRQAPGRATEWVSAI
SWNGNNTYYTESMKGRFTISRDNAKNTVYLQMNSLRPEDTAVYYCVKGSTAIVGVP
PTYPDEYDYWGQGTLVTVSS

< IL6R82, SEQ ID NO: 620"; PRT; ->"
EVQLVESGGGLVQPGGSLRLSCAASGFTFDDYGMSWVRQAPGKGLEWVSAI
SWNGNNTYYTESMKGRFTISRDNAKNTVYLQMNSLRPEDTAVYYCVKGSTAIVGVP
PTYPDEYDYWGQGTLVTVSS

< IL6R83, SEQ ID NO: 621"; PRT; ->"
EVQLVESGGGLVQPGGSLRLSCAASGFTFDDYGMSWVRQAPGRATEWVSAI
SWNGNNTYYTESMKGRFTISRDNAKNTLYLQMNSLRPEDTAVYYCVKGSTAIVGVP
PTYPDEYDYWGQGTLVTVSS

< IL6R84, SEQ ID NO: 622"; PRT; ->"
EVQLVESGGGLVQPGGSLRLSCAASGFTFDDYGMSWVRQAPGKGLEWVSAI
SWNGNNTYYTESMKGRFTISRDNAKNTLYLQMNSLRPEDTAVYYCVKGSTAIVGVP
PTYPDEYDYWGQGTLVTVSS

< IL6R85, SEQ ID NO: 623"; PRT; ->"
EVQLVESGGGLVQPGGSLRLSCAASGFTFDDYGMSWVRQAPGRGLEWVSAI
SWNGNNTYYTESMKGRFTISRDNAKNTLYLQMNSLRPEDTAVYYCVKGSTAIVGVP
PTYPDEYDYWGQGTLVTVSS

< IL6R86, SEQ ID NO: 624"; PRT; ->"
EVQLVESGGGLVQPGGSLRLSCAASGFTFDDYGMSWVRQAPGRALEWVSAI
SWNGNNTYYTESMKGRFTISRDNAKNTLYLQMNSLRPEDTAVYYCVKGSTAIVGVP
PTYPDEYDYWGQGTLVTVSS

< IL6R87, SEQ ID NO: 625"; PRT; ->"
EVQLVESGGGLVQPGGSLRLSCAASGFTFDDYGMSWVRQAPGKATEWVSAI
SWNGNNTYYTESMKGRFTISRDNAKNTLYLQMNSLRPEDTAVYYCVKGSTAIVGVP
PTYPDEYDYWGQGTLVTVSS

< IL6R88, SEQ ID NO: 626"; PRT; ->"
EVQLVESGGGLVQPGGSLRLSCAASGFTFDDYGMSWVRQAPGKGTEWVSAI
SWNGNNTYYTESMKGRFTISRDNAKNTLYLQMNSLRPEDTAVYYCVKGSTAIVGVP
PTYPDEYDYWGQGTLVTVSS

< IL6R89, SEQ ID NO: 627"; PRT; ->"
EVQLVESGGGLVQPGGSLRLSCAASGFTFDDYGMSWVRQAPGRGTEWVSAI
SWNGNNTYYTESMKGRFTISRDNAKNTLYLQMNSLRPEDTAVYYCVKGSTAIVGVP
PTYPDEYDYWGQGTLVTVSS

< IL6R90, SEQ ID NO: 628"; PRT; ->"
EVQLVESGGGLVQPGGSLRLSCAASGFTFDDYGMSWVRQAPGKALEWVSAI
SWNGNNTYYTESMKGRFTISRDNAKNTLYLQMNSLRPEDTAVYYCVKGSTAIVGVP
PTYPDEYDYWGQGTLVTVSS

< REFERENCE IGG HEAVY CHAIN, SEQ ID NO: 629"; PRT; ->"
QVQLQESGPGLVRPSQTLSLTCTVSGYSITSDHAWSWVRQPPGRGLEWIGYIS
YSGITTYNPSLKSRVTMLRDTSKNQFSLRLSSVTAADTAVYYCARSLARTTAMDYW
GQGSLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCDK
THTCPPCPAPELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPAPIEKTI
SKAKGQPREPQVYTLPPSRDELTKNQVSLTCLVKGFYPSDIAVEWESNGQPENNYKT
TPPVLDSDGSFFLYSKLTVDKSRWQQGNVFSCSVMHEALHNHYTQKSLSLSPGK

< REFERENCE IGG LIGHT CHAIN, SEQ ID NO: 630"; PRT; ->"
DIQMTQSPSSLSASVGDRVTITCRASQDISSYLNWYQQKPGKAPKLLIYYTSR
LHSGVPSRFSGSGSGTDFTFTISSLQPEDIATYYCQQGNTLPYTFGQGTKVEIKRTVAA
PSVFIFPPSDEQLKSGTASVVCLLNNFYPREAKVQWKVDNALQSGNSQESVTEQDSK
DSTYSLSSTLTLSKADYEKHKVYACEVTHQGLSSPVTKSFNRGEC

< REFERENCE FAB HEAVY CHAIN, SEQ ID NO: 631"; PRT; ->"
QVQLQESGPGLVRPSQTLSLTCTVSGYSITSDHAWSWVRQPPGRGLEWIGYIS
YSGITTYNPSLKSRVTMLRDTSKNQFSLRLSSVTAADTAVYYCARSLARTTAMDYW
GQGSLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSC

< REFERENCE FAB LIGHT CHAIN, SEQ ID NO: 632"; PRT; ->"
DIQMTQSPSSLSASVGDRVTITCRASQDISSYLNWYQQKPGKAPKLLIYYTSR
LHSGVPSRFSGSGSGTDFTFTISSLQPEDIATYYCQQGNTLPYTFGQGTKVEIKRTVAA
PSVFIFPPSDEQLKSGTASVVCLLNNFYPREAKVQWKVDNALQSGNSQESVTEQDSK
DSTYSLSSTLTLSKADYEKHKVYACEVTHQGLSSPVTKSFNRGEC

TABLE B-1-continued

Nanobodies and polypeptides against the IL-6 receptor.

< IL6R *MACACA FASCICULARIS*, SEQ ID NO: 633"; PRT; ->"
LAPGGCPAQEVARGVLTSLPGDSVTLTCPGGEPEDNATVHWVLRKPAEGSHL
SRWAGVGRRLLLRSVQLHDSGNYSCYRAGRPAATVHLLVDVPPEEPQLSCFRKSPLS
NVVCEWGPRSTPSPTTKAVLLVRKFQNSPAEDFQEPCQYSQESQKFSCQLAVPEGDS
SFYIVSMCVASSVGSKLSKTQTFQGCGILQPDPPANITVTAVARNPRWLSVTWQDPH
SWNSSFYRLRFELRYRAERSKTFTTWMVKDLQHHCVIHDAWSGLRHVVQLRAQEE
FGQGEWSEWSPEAMGTPWTESRSPPAENEVSTPTQAPTTNKDDDNILSGDSANATSL
PVQD

"(t)" refers to a translated protein. Leader sequences and N-terminal sequences are given as SEQ ID NO's: 472-477.

The term and expressions which have been employed are used as terms of description and not of limitation, and there is no intention in the use of such terms and expressions of excluding any equivalents of the features shown and described or portions thereof, it being recognized that various modifications are possible within the scope of the invention.

All of the references described herein are incorporated by reference, in particular of the teaching that is referenced hereinabove.

SEQUENCE LISTING (649 sequences)

SEQ ID NO: 1 - protein, 26 aa, Artificial
  FR1
  misc_feature (11)..(11): Hallmark residue: L, M, S, V or W; preferably L
QVQLQESGGGXVQAGGSLRLSCAASG

SEQ ID NO: 2 - protein, 14 aa, Artificial
  FR2
  misc_feature (2)..(2): Hallmark residue: F, H, I, L, Y or V; preferably F or V
  misc_feature (9)..(9): Hallmark residue: G, E, A, D, Q, R, S or L; preferably G, E or Q; most preferably G or E
  misc_feature (10)..(10): Hallmark residue: L, R, C, I, L, P, Q or V; preferably L or R
  misc_feature (12)..(12): Hallmark residue: W, L, F, A, G, I, M, R, S, V or Y; preferably W, L, F or R
WXRQAPGKXXEXVA

SEQ ID NO: 3 - protein, 32 aa, Artificial
  FR3
  misc_feature (21)..(21): Hallmark residue: R, K, N, E, G, I, M, Q or T; preferably K or R; most preferably R
  misc_feature (22)..(22): Hallmark residue: P, A, D, L, R, S, T or V; preferably P
RFTISRDNAKNTVYLQMNSLXXEDTAVYYCAA

SEQ ID NO: 4 - protein, 11 aa, Artificial
  FR4
  misc_feature (1)..(1): Hallmark residue: W, P, R or S; preferably W
  misc_feature (2)..(2): Hallmark residue: G or D; preferably G
  misc_feature (6)..(6): Hallmark residue: Q, L or R; preferably Q or L
XXQGTXVTVSS

SEQ ID NO: 5 - protein, 26 aa, Artificial
  FR1
QVQLQESGGGLVQAGGSLRLSCAASG

SEQ ID NO: 6 - protein, 14 aa, Artificial
  FR2
WFRQAPGKERELVA

SEQ ID NO: 7 - protein, 14 aa, Artificial
  FR2
WFRQAPGKEREFVA

SEQ ID NO: 8 - protein, 13 aa, Artificial
  FR2
WFRQAPGKEREGA

SEQ ID NO: 9 - protein, 14 aa, Artificial
  FR2
WFRQAPGKQRELVA

SEQ ID NO: 10 - protein, 14 aa, Artificial
  FR2
WFRQAPGKQREFVA

SEQ ID NO: 11 - protein, 13 aa, Artificial
  FR2
WYRQAPGKGLEWA

SEQ ID NO: 12 - protein, 32 aa, Artificial
  FR3
RFTISRDNAKNTVYLQMNSLKPEDTAVYYCAA

SEQ ID NO: 13 - protein, 11 aa, Artificial
  FR4
WGQGTQVTVSS

SEQ ID NO: 14 - protein, 11 aa, Artificial
  FR4
WGQGTLVTVSS

SEQ ID NO: 15 - protein, 5 aa, Artificial
  CDR1
SFGMS

SEQ ID NO: 16 - protein, 5 aa, Artificial
  CDR1
LNLMG

SEQ ID NO: 17 - protein, 5 aa, Artificial
  CDR1
INLLG

SEQ ID NO: 18 - protein, 5 aa, Artificial
  CDR1
NYWMY

SEQ ID NO: 19 - protein, 17 aa, Artificial
  CDR2
SISGSGSDTLYADSVKG

SEQ ID NO: 20 - protein, 16 aa, Artificial
  CDR2
TITVGDSTNYADSVKG

SEQ ID NO: 21 - protein, 16 aa, Artificial
  CDR2
TITVGDSTSYADSVKG

SEQ ID NO: 22 - protein, 17 aa, Artificial
  CDR2
SINGRGDDTRYADSVKG

SEQ ID NO: 23 - protein, 17 aa, Artificial
  CDR2
AISADSSTKNYADSVKG

SEQ ID NO: 24 - protein, 17 aa, Artificial
  CDR2
AISADSSDKRYADSVKG

SEQ ID NO: 25 - protein, 17 aa, Artificial
  CDR2
RISTGGGYSYYADSVKG

SEQ ID NO: 26 - protein, 13 aa, Artificial
  CDR3
DREAQVDTLDFDY

SEQ ID NO: 27 - protein, 6 aa, Artificial
  CDR3
GGSLSR

SEQ ID NO: 28 - protein, 8 aa, Artificial
  CDR3
RRTWHSEL

SEQ ID NO: 29 - protein, 7 aa, Artificial
  CDR3
GRSVSRS

SEQ ID NO: 30 - protein, 5 aa, Artificial
  CDR3
GRGSP

SEQ ID NO: 31 - protein, 17 aa, Artificial
  myc-tag
AAAEQKLISEEDLNGAA

SEQ ID NO: 32 - protein, 115 aa, Artificial [sequence omitted]

SEQ ID NO: 33 - protein, 115 aa, Artificial [sequence omitted]

SEQ ID NO: 34 - protein, 117 aa, Artificial
  Nanobody
AVQLVESGGGLVQGGGSLRLACAASERIFDLNLMGWYRQGPGNERELVATCITVGDSTNYADSVKGRFTISMDYTKQTVYLHMNSLRPEDTGLYYCKIRRTWHSELWGQGTQVTVSS

SEQ ID NO: 35 - protein, 125 aa, Artificial
  Nanobody
EVQLQASGGGLVQAGGSLRLSCSASVRTFSIYAMGWFRQAPGKEREFVAGINRSGDVTKYADFVKGRFSISRDNAKNMVYLQMNSLKPEDTALYYCAATWAYDTVGALTSGYNFWGQGTQVTVSS

SEQ ID NO: 36 - protein, 122 aa, Artificial
  Nanobody
EVQLQASGGGLVQAGGSLRLSCAASGFKITHYTMGWFRQAPGKEREFVSRITWGGDNTFYSNSVKGRFTISRDNAKNTVYLQMNSLKPEDTADYYCAAGSTSTATPLRVDYWGKGTQVTVSS

SEQ ID NO: 37 - protein, 30 aa, Artificial
  linker
GGGGSGGGGSGGGGSGGGGSGGGGSGGGGS

SEQ ID NO: 38 - protein, 15 aa, Artificial
  linker
GGGGSGGGGSGGGGS

SEQ ID NO: 39 - protein, 9 aa, Artificial
  linker
GGGGSGGGS

SEQ ID NO: 40 - protein, 7 aa, Artificial
  linker
SGGSGGS

SEQ ID NO: 41 - protein, 12 aa, Artificial
  linker
EPKTPKPQPAAA

SEQ ID NO: 42 - protein, 30 aa, Artificial
  FR or CDR or nanobody sequence
EVQLVESGGGLVQPGGSLRLSCAASGFSLD

SEQ ID NO: 43 - protein, 30 aa, Artificial; identical to SEQ ID NO: 42
  FR or CDR or nanobody sequence

SEQ ID NO: 44 - protein, 30 aa, Artificial
  FR or CDR or nanobody sequence
EVQLVESGGGLVQPGGSLRLSCAASGFTLD

SEQ ID NO: 45 - protein, 30 aa, Artificial; identical to SEQ ID NO: 44
  FR or CDR or nanobody sequence

SEQ ID NO: 46 - protein, 30 aa, Artificial
  FR or CDR or nanobody sequence
EVQLVESGGGLVQPGGSLRLSCVASGFSLD

SEQ ID NO: 47 - protein, 30 aa, Artificial
  FR or CDR or nanobody sequence
EVQLVESGGGLVQPGGSLRLSCAASGFTLG

SEQ ID NO: 48 - protein, 30 aa, Artificial; identical to SEQ ID NO: 47
  FR or CDR or nanobody sequence

SEQ ID NO: 49 - protein, 30 aa, Artificial
  FR or CDR or nanobody sequence
EVQLVESGGGLVQPGGSLRLSCAASGFTFD

SEQ ID NO: 50 - protein, 30 aa, Artificial; identical to SEQ ID NO: 42
  FR or CDR or nanobody sequence

SEQ ID NO: 51 - protein, 30 aa, Artificial
  FR or CDR or nanobody sequence
EVQLVESGGGLVQPGGSLRLSCAASGFTFG

SEQ ID NO: 52 - protein, 30 aa, Artificial
  FR or CDR or nanobody sequence
EVQLVESGGGLVQAGGSLRLSCAASGFTFD

SEQ ID NO: 53 - protein, 30 aa, Artificial; identical to SEQ ID NO: 51
  FR or CDR or nanobody sequence

SEQ ID NO: 54 - protein, 30 aa, Artificial; identical to SEQ ID NO: 52
  FR or CDR or nanobody sequence

SEQ ID NO: 55 - protein, 30 aa, Artificial; identical to SEQ ID NO: 51
  FR or CDR or nanobody sequence

SEQ ID NO: 56 - protein, 30 aa, Artificial; identical to SEQ ID NO: 52
  FR or CDR or nanobody sequence

SEQ ID NO: 57 - protein, 30 aa, Artificial; identical to SEQ ID NO: 51
  FR or CDR or nanobody sequence

SEQ ID NO: 58 - protein, 30 aa, Artificial; identical to SEQ ID NO: 51
  FR or CDR or nanobody sequence

SEQ ID NO: 59 - protein, 30 aa, Artificial; identical to SEQ ID NO: 46
  FR or CDR or nanobody sequence

SEQ ID NO: 60 - protein, 30 aa, Artificial; identical to SEQ ID NO: 44
  FR or CDR or nanobody sequence

SEQ ID NO: 61 - protein, 30 aa, Artificial; identical to SEQ ID NO: 44
  FR or CDR or nanobody sequence

SEQ ID NO: 62 - protein, 30 aa, Artificial; identical to SEQ ID NO: 44
  FR or CDR or nanobody sequence

SEQ ID NO: 63 - protein, 30 aa, Artificial; identical to SEQ ID NO: 49
  FR or CDR or nanobody sequence

SEQ ID NO: 64 - protein, 30 aa, Artificial; identical to SEQ ID NO: 51
  FR or CDR or nanobody sequence

SEQ ID NO: 65 - protein, 30 aa, Artificial; identical to SEQ ID NO: 51
  FR or CDR or nanobody sequence

SEQ ID NO: 66 - protein, 30 aa, Artificial; identical to SEQ ID NO: 51
  FR or CDR or nanobody sequence

SEQ ID NO: 67 - protein, 30 aa, Artificial; identical to SEQ ID NO: 51
  FR or CDR or nanobody sequence

SEQ ID NO: 68 - protein, 30 aa, Artificial
  FR or CDR or nanobody sequence
EVQLVESGGGLVQPGGSLRLSCAASGFTLN

SEQ ID NO: 69 - protein, 30 aa, Artificial; identical to SEQ ID NO: 51
  FR or CDR or nanobody sequence

SEQ ID NO: 70 - protein, 30 aa, Artificial; identical to SEQ ID NO: 42
  FR or CDR or nanobody sequence

SEQ ID NO: 71 - protein, 30 aa, Artificial; identical to SEQ ID NO: 49
  FR or CDR or nanobody sequence

SEQ ID NO: 72 - protein, 30 aa, Artificial
  FR or CDR or nanobody sequence
EVQLVESGGGLVQAGGSLRLSCAASGRTFS

SEQ ID NO: 73 - protein, 30 aa, Artificial; identical to SEQ ID NO: 52
  FR or CDR or nanobody sequence

SEQ ID NO: 74 - protein, 30 aa, Artificial; identical to SEQ ID NO: 72
  FR or CDR or nanobody sequence

SEQ ID NO: 75 - protein, 30 aa, Artificial
  FR or CDR or nanobody sequence
EVQLVESGGGLVQAGGSLRLSCAASGRTSS

SEQ ID NO: 76 - protein, 30 aa, Artificial; identical to SEQ ID NO: 44
  FR or CDR or nanobody sequence

SEQ ID NO: 77 - protein, 30 aa, Artificial; identical to SEQ ID NO: 72
  FR or CDR or nanobody sequence

SEQ ID NO: 78 - protein, 30 aa, Artificial
  FR or CDR or nanobody sequence
EVQLVESGGGLVQPGGSLRLSCAAAGFTLD

SEQ ID NO: 79 - protein, 30 aa, Artificial; identical to SEQ ID NO: 46
  FR or CDR or nanobody sequence

SEQ ID NO: 80 - protein, 30 aa, Artificial; identical to SEQ ID NO: 44
  FR or CDR or nanobody sequence

SEQ ID NO: 81 - protein, 30 aa, Artificial
  FR or CDR or nanobody sequence
EVQLVESGGGLVQAGGSLRLSCAASGNIFD

SEQ ID NO: 82 - protein, 30 aa, Artificial; identical to SEQ ID NO: 51
  FR or CDR or nanobody sequence

SEQ ID NO: 83 - protein, 30 aa, Artificial; identical to SEQ ID NO: 52
  FR or CDR or nanobody sequence

SEQ ID NO: 84 - protein, 30 aa, Artificial
  FR or CDR or nanobody sequence
EVQLVESGGGLVQAGGSLRLSCAASGSIFK

SEQ ID NO: 85 - protein, 30 aa, Artificial; identical to SEQ ID NO: 72
  FR or CDR or nanobody sequence

SEQ ID NO: 86 - protein, 30 aa, Artificial
  FR or CDR or nanobody sequence
EVQLVESGGGLVQAGGSLRLSCTASGNIFS

SEQ ID NO: 87 - protein, 30 aa, Artificial
  FR or CDR or nanobody sequence
EVQLVESGGGFVQAGGSLRLSCIASGDNFS

SEQ ID NO: 88 - protein, 30 aa, Artificial; identical to SEQ ID NO: 72
  FR or CDR or nanobody sequence

SEQ ID NO: 89 - protein, 30 aa, Artificial
  FR or CDR or nanobody sequence
EVQLVESGGGLVQAGGSLRLSCAASGRTLS

SEQ ID NO: 90 - protein, 30 aa, Artificial; identical to SEQ ID NO: 44
  FR or CDR or nanobody sequence

SEQ ID NO: 91 - protein, 30 aa, Artificial; identical to SEQ ID NO: 72
  FR or CDR or nanobody sequence

SEQ ID NO: 92 - protein, 30 aa, Artificial
  FR or CDR or nanobody sequence
EVQLVESGGGLVQAGGSLRLSCAASGLTDD

SEQ ID NO: 93 - protein, 5 aa, Artificial
  FR or CDR or nanobody sequence
YYAIG

SEQ ID NO: 94 - protein, 5 aa, Artificial
  FR or CDR or nanobody sequence
YYAIG

SEQ ID NO: 95 - protein, 5 aa, Artificial
  FR or CDR or nanobody sequence
YYAIG

SEQ ID NO: 96 - protein, 5 aa, Artificial
  FR or CDR or nanobody sequence
YFAIG

SEQ ID NO: 97 - protein, 5 aa, Artificial
  FR or CDR or nanobody sequence
YYVIG

SEQ ID NO: 98 - protein, 5 aa, Artificial
  FR or CDR or nanobody sequence
YFAIG

SEQ ID NO: 99 - protein, 5 aa, Artificial
  FR or CDR or nanobody sequence
YFAIG

SEQ ID NO: 100 - protein, 5 aa, Artificial
  FR or CDR or nanobody sequence
DYGMS

SEQ ID NO: 101 - protein, 5 aa, Artificial
  FR or CDR or nanobody sequence
YYAIG

SEQ ID NO: 102 - protein, 5 aa, Artificial
  FR or CDR or nanobody sequence
SYDMS

SEQ ID NO: 103 - protein, 5 aa, Artificial
  FR or CDR or nanobody sequence
DYAIG

SEQ ID NO: 104 - protein, 5 aa, Artificial
  FR or CDR or nanobody sequence
SYDMS

SEQ ID NO: 105 - protein, 5 aa, Artificial
  FR or CDR or nanobody sequence
DYAIG

SEQ ID NO: 106 - protein, 5 aa, Artificial
  FR or CDR or nanobody sequence
SYDMS

SEQ ID NO: 107 - protein, 5 aa, Artificial
  FR or CDR or nanobody sequence
DYAIG

SEQ ID NO: 108 - protein, 5 aa, Artificial
  FR or CDR or nanobody sequence
SYDMS

SEQ ID NO: 109 - protein, 5 aa, Artificial
  FR or CDR or nanobody sequence
SYDMS

SEQ ID NO: 110 - protein, 5 aa, Artificial
  FR or CDR or nanobody sequence
YYVIG

SEQ ID NO: 111 - protein, 5 aa, Artificial
  FR or CDR or nanobody sequence
YYVIG

SEQ ID NO: 112 - protein, 5 aa, Artificial
  FR or CDR or nanobody sequence
YYAIG

SEQ ID NO: 113 - protein, 5 aa, Artificial
  FR or CDR or nanobody sequence
YYVIG

SEQ ID NO: 114 - protein, 5 aa, Artificial
  FR or CDR or nanobody sequence
DYGMS

SEQ ID NO: 115 - protein, 5 aa, Artificial
  FR or CDR or nanobody sequence
SYDMS

SEQ ID NO: 116 - protein, 5 aa, Artificial
  FR or CDR or nanobody sequence
SYDMS

SEQ ID NO: 117 - protein, 5 aa, Artificial
  FR or CDR or nanobody sequence
SYDMS

SEQ ID NO: 118 - protein, 5 aa, Artificial
  FR or CDR or nanobody sequence
SYDMS

SEQ ID NO: 119 - protein, 5 aa, Artificial
  FR or CDR or nanobody sequence
YYAIG

SEQ ID NO: 120 - protein, 5 aa, Artificial
  FR or CDR or nanobody sequence
SYDMS

SEQ ID NO: 121 - protein, 5 aa, Artificial
  FR or CDR or nanobody sequence
YYAIG

SEQ ID NO: 122 - protein, 5 aa, Artificial
  FR or CDR or nanobody sequence
DYGMS

SEQ ID NO: 123 - protein, 5 aa, Artificial
  FR or CDR or nanobody sequence
SYDMG

SEQ ID NO: 124 - protein, 5 aa, Artificial
  FR or CDR or nanobody sequence
DYAIG

SEQ ID NO: 125 - protein, 5 aa, Artificial
  FR or CDR or nanobody sequence
SYDMG

SEQ ID NO: 126 - protein, 5 aa, Artificial
  FR or CDR or nanobody sequence
SYDMT

SEQ ID NO: 127 - protein, 5 aa, Artificial
  FR or CDR or nanobody sequence
YYAIG

SEQ ID NO: 128 - protein, 5 aa, Artificial
  FR or CDR or nanobody sequence
SYAMG

SEQ ID NO: 129 - protein, 5 aa, Artificial
  FR or CDR or nanobody sequence
YSAIG

SEQ ID NO: 130 - protein, 5 aa, Artificial
  FR or CDR or nanobody sequence
YYVIG

SEQ ID NO: 131 - protein, 5 aa, Artificial
  FR or CDR or nanobody sequence
YGAIG

SEQ ID NO: 132 - protein, 7 aa, Artificial
  FR or CDR or nanobody sequence
DNTMGWT

SEQ ID NO: 133 - protein, 5 aa, Artificial
  FR or CDR or nanobody sequence
SYDMS

SEQ ID NO: 134 - protein, 5 aa, Artificial
  FR or CDR or nanobody sequence
DYDIG

SEQ ID NO: 135 - protein, 5 aa, Artificial
  FR or CDR or nanobody sequence
VNAMG

SEQ ID NO: 136 - protein, 5 aa, Artificial
  FR or CDR or nanobody sequence
SYDMG

SEQ ID NO: 137 - protein, 5 aa, Artificial
  FR or CDR or nanobody sequence
TETMG

SEQ ID NO: 138 - protein, 5 aa, Artificial
  FR or CDR or nanobody sequence
INRMG

SEQ ID NO: 139 - protein, 5 aa, Artificial
  FR or CDR or nanobody sequence
GADAG

SEQ ID NO: 140 - protein, 5 aa, Artificial
  FR or CDR or nanobody sequence
SYDMG

SEQ ID NO: 141 - protein, 5 aa, Artificial
  FR or CDR or nanobody sequence
SYAIG

SEQ ID NO: 142 - protein, 5 aa, Artificial
  FR or CDR or nanobody sequence
NIAMG

SEQ ID NO: 143 - protein, 5 aa, Artificial
  FR or CDR or nanobody sequence
DFAIG

SEQ ID NO: 144 - protein, 14 aa, Artificial
  FR or CDR or nanobody sequence
WFRQAPGKEREGVS

SEQ ID NO: 145 - protein, 14 aa, Artificial
  FR or CDR or nanobody sequence
WFRQAPGKEREGVS

SEQ ID NO: 146 - protein, 14 aa, Artificial
  FR or CDR or nanobody sequence
WFRQAPGKEREGVS

SEQ ID NO: 147 - protein, 14 aa, Artificial
  FR or CDR or nanobody sequence
WFRQAPGKERERVS

SEQ ID NO: 148 - protein, 14 aa, Artificial
  FR or CDR or nanobody sequence
WFRQAPGKEREGVS

SEQ ID NO: 149 - protein, 14 aa, Artificial
  FR or CDR or nanobody sequence
WFRQAPGKEREGVS

SEQ ID NO: 150 - protein, 14 aa, Artificial
  FR or CDR or nanobody sequence
WFRQAPGKEREGVS

SEQ ID NO: 151 - protein, 14 aa, Artificial
  FR or CDR or nanobody sequence
WVRQAPGKGLEWVS

SEQ ID NO: 152 - protein, 14 aa, Artificial
  FR or CDR or nanobody sequence
WFRQAPGKEREGVS

SEQ ID NO: 153 - protein, 14 aa, Artificial
  FR or CDR or nanobody sequence
WVRQAPGKGPEWVS

SEQ ID NO: 154 - protein, 14 aa, Artificial
  FR or CDR or nanobody sequence
WFRQAPGKEREGIS

SEQ ID NO: 155 - protein, 14 aa, Artificial
  FR or CDR or nanobody sequence
WVRQAPGKGPEWVS

SEQ ID NO: 156 - protein, 14 aa, Artificial
  FR or CDR or nanobody sequence
WFRQAPGKEREGVS

SEQ ID NO: 157 - protein, 14 aa, Artificial
  FR or CDR or nanobody sequence
WVRQAPGKGPEWVS

SEQ ID NO: 158 - protein, 14 aa, Artificial
  FR or CDR or nanobody sequence
WFRQAPGKEREGVS

SEQ ID NO: 159 - protein, 14 aa, Artificial
  FR or CDR or nanobody sequence
WVRQAPGKGPEWVS

SEQ ID NO: 160 - protein, 14 aa, Artificial
  FR or CDR or nanobody sequence
WVRQAPGKGPEWVS

SEQ ID NO: 161 - protein, 14 aa, Artificial
  FR or CDR or nanobody sequence
WFRQAPGKEREGVS

SEQ ID NO: 162 - protein, 14 aa, Artificial
  FR or CDR or nanobody sequence
WFRQAPGKEREAVA

SEQ ID NO: 163 - protein, 14 aa, Artificial
  FR or CDR or nanobody sequence
WWRQAPGKGREGVS

SEQ ID NO: 164 - protein, 14 aa, Artificial
  FR or CDR or nanobody sequence
WFRQAPGKEREGVS

SEQ ID NO: 165 - protein, 14 aa, Artificial
  FR or CDR or nanobody sequence
WVRQAPGKGLEWVS

SEQ ID NO: 166 - protein, 14 aa, Artificial
  FR or CDR or nanobody sequence
WVRQAPGKGPEWVS

SEQ ID NO: 167 - protein, 14 aa, Artificial
  FR or CDR or nanobody sequence
WVRQAPGKGPEWVS

SEQ ID NO: 168 - protein, 14 aa, Artificial
  FR or CDR or nanobody sequence
WVRQAPGKGPEWVS

SEQ ID NO: 169 - protein, 14 aa, Artificial
  FR or CDR or nanobody sequence
WVRQAPGKGPEWVS

SEQ ID NO: 170 - protein, 14 aa, Artificial
  FR or CDR or nanobody sequence
WFRQAPGKEREGVS

SEQ ID NO: 171 - protein, 14 aa, Artificial
  FR or CDR or nanobody sequence
WVRQAPGKGPEWVS

SEQ ID NO: 172 - protein, 14 aa, Artificial
  FR or CDR or nanobody sequence
WFRQAPGKEREGVS

SEQ ID NO: 173 - protein, 14 aa, Artificial
  FR or CDR or nanobody sequence
WVRQAPGRATEWVS

SEQ ID NO: 174 - protein, 14 aa, Artificial
  FR or CDR or nanobody sequence
WYRQAPGKEREFVA

SEQ ID NO: 175 - protein, 14 aa, Artificial
  FR or CDR or nanobody sequence
WFRQAPGKEHEGVS

SEQ ID NO: 176 - protein, 14 aa, Artificial
  FR or CDR or nanobody sequence
WYRQAPGKEREFVA

SEQ ID NO: 177 - protein, 14 aa, Artificial
  FR or CDR or nanobody sequence
WYRQVPGKEREFVA

SEQ ID NO: 178 - protein, 14 aa, Artificial
  FR or CDR or nanobody sequence
WFRQAPGKERERVS

SEQ ID NO: 179 - protein, 14 aa, Artificial
  FR or CDR or nanobody sequence
WGRQAPGKEREFVA

SEQ ID NO: 180 - protein, 14 aa, Artificial
  FR or CDR or nanobody sequence
WFRQAPGKEREMFS

SEQ ID NO: 181 - protein, 14 aa, Artificial
  FR or CDR or nanobody sequence
WFRQAPGKEREGVS

SEQ ID NO: 182 - protein, 14 aa, Artificial
  FR or CDR or nanobody sequence
WFRQAPGKEREGVS

SEQ ID NO: 183 - protein, 14 aa, Artificial
  FR or CDR or nanobody sequence
WNRQPPGKQRELVA

SEQ ID NO: 184 - protein, 14 aa, Artificial
  FR or CDR or nanobody sequence
WVRQAPGKGPEWVS

SEQ ID NO: 185 - protein, 14 aa, Artificial
  FR or CDR or nanobody sequence
WFRQAPGKEREGVS

SEQ ID NO: 186 - protein, 14 aa, Artificial
  FR or CDR or nanobody sequence
WYRQAPGKQRELVA

SEQ ID NO: 187 - protein, 14 aa, Artificial
  FR or CDR or nanobody sequence
WYRQAPGKEREFVA

SEQ ID NO: 188 - protein, 13 aa, Artificial
  FR or CDR or nanobody sequence
WYRQPPGKQRDVV

SEQ ID NO: 189 - protein, 14 aa, Artificial
  FR or CDR or nanobody sequence
WYRQALGKQRELVA

SEQ ID NO: 190 - protein, 14 aa, Artificial
  FR or CDR or nanobody sequence
WNRQTPGKEREFVA

SEQ ID NO: 191 - protein, 14 aa, Artificial
  FR or CDR or nanobody sequence
WYRQGPGKEREFVA

SEQ ID NO: 192 - protein, 14 aa, Artificial
  FR or CDR or nanobody sequence
WFRQAPGKEPEGVS

SEQ ID NO: 193 - protein, 14 aa, Artificial
  FR or CDR or nanobody sequence
WIREAPGKEREFVA

SEQ ID NO: 194 - protein, 14 aa, Artificial
  FR or CDR or nanobody sequence
WFRQAPGKEPEGVS

SEQ ID NO: 195 - protein, 19 aa, Artificial
  FR or CDR or nanobody sequence
CMDSSAGTTSTYYSDSVKG

SEQ ID NO: 196 - protein, 19 aa, Artificial
  FR or CDR or nanobody sequence
CMDSSDGTTNTYYSDSVKG

SEQ ID NO: 197 - protein, 17 aa, Artificial
  FR or CDR or nanobody sequence
CISSSDGSTYYADSVKG

SEQ ID NO: 198 - protein, 17 aa, Artificial
  FR or CDR or nanobody sequence
CISSSDGSTYYADSVKG

SEQ ID NO: 199 - protein, 17 aa, Artificial
  FR or CDR or nanobody sequence
CISSSDGSTYYADSVKG

SEQ ID NO: 200 - protein, 17 aa, Artificial
  FR or CDR or nanobody sequence
CISSSDGSTYYADSVKG

SEQ ID NO: 201 - protein, 17 aa, Artificial
  FR or CDR or nanobody sequence
CISSSDGSAYYADSVKG

SEQ ID NO: 202 - protein, 17 aa, Artificial
  FR or CDR or nanobody sequence
AISWNGGSTYYTESMKG

SEQ ID NO: 203 - protein, 19 aa, Artificial
  FR or CDR or nanobody sequence
CMDSSGGTTSTYYSDSVKG

SEQ ID NO: 204 - protein, 17 aa, Artificial
  FR or CDR or nanobody sequence
AINSGGGSTYYADSVKG

SEQ ID NO: 205 - protein, 17 aa, Artificial
  FR or CDR or nanobody sequence
CISSSDGSTYYADSVKG

SEQ ID NO: 206 - protein, 17 aa, Artificial
  FR or CDR or nanobody sequence
AINSGGGSTYYADSVKG

SEQ ID NO: 207 - protein, 17 aa, Artificial
  FR or CDR or nanobody sequence
GISSSDGNTYYADSVKG

SEQ ID NO: 208 - protein, 17 aa, Artificial
  FR or CDR or nanobody sequence
AINSGGGSTYYADSVKG

SEQ ID NO: 209 - protein, 17 aa, Artificial
  FR or CDR or nanobody sequence
CISSSDGSTYYADSVKG

SEQ ID NO: 210 - protein, 17 aa, Artificial
  FR or CDR or nanobody sequence
AINSGGGSTYYADSVKG

SEQ ID NO: 211 - protein, 17 aa, Artificial
  FR or CDR or nanobody sequence
AINSGGGSTYYADSVKG

SEQ ID NO: 212 - protein, 17 aa, Artificial
  FR or CDR or nanobody sequence
CISSSDGSTYYADSVKG

SEQ ID NO: 213 - protein, 17 aa, Artificial
  FR or CDR or nanobody sequence
CISSSDRSTYYADSVKG

SEQ ID NO: 214 - protein, 17 aa, Artificial
  FR or CDR or nanobody sequence
CISSGDGSTNYADSVKG

SEQ ID NO: 215 - protein, 17 aa, Artificial
  FR or CDR or nanobody sequence
CIGSSDDSTYYADSVKG

SEQ ID NO: 216 - protein, 17 aa, Artificial
  FR or CDR or nanobody sequence
AISWNGGSTYYTESMKG

SEQ ID NO: 217 - protein, 17 aa, Artificial
  FR or CDR or nanobody sequence
AINSGGGSTYYADSVKG

SEQ ID NO: 218 - protein, 17 aa, Artificial
  FR or CDR or nanobody sequence
AINSGGGSTYYADSVKG

SEQ ID NO: 219 - protein, 17 aa, Artificial
  FR or CDR or nanobody sequence
AINSGGGSTYYADSVKG

SEQ ID NO: 220 - protein, 17 aa, Artificial
  FR or CDR or nanobody sequence
AINSGGDNTYYADSVKG

SEQ ID NO: 221 - protein, 17 aa, Artificial
  FR or CDR or nanobody sequence
CISSSDGSTYYADSVKG

SEQ ID NO: 222 - protein, 17 aa, Artificial
  FR or CDR or nanobody sequence
AINSGGGSTYYADSVKG

SEQ ID NO: 223 - protein, 19 aa, Artificial
  FR or CDR or nanobody sequence
CMDSSSGTTSTYYSDSVKG

SEQ ID NO: 224 - protein, 17 aa, Artificial
  FR or CDR or nanobody sequence
AISWNGNNTYYTESMKG

SEQ ID NO: 225 - protein, 16 aa, Artificial
  FR or CDR or nanobody sequence
IITWNSSTYYADSVKG

SEQ ID NO: 226 - protein, 17 aa, Artificial
  FR or CDR or nanobody sequence
CISSSDGSTYYADSVKG

SEQ ID NO: 227 - protein, 17 aa, Artificial
  FR or CDR or nanobody sequence
VIHWSSGSTYYADPVKG

SEQ ID NO: 228 - protein, 17 aa, Artificial
  FR or CDR or nanobody sequence
VISWSGGSTYYADSVKG

SEQ ID NO: 229 - protein, 17 aa, Artificial
  FR or CDR or nanobody sequence
CISSSDGSTYYADSVKG

SEQ ID NO: 230 - protein, 17 aa, Artificial
  FR or CDR or nanobody sequence
TISWSGGSTYYADSVKG

SEQ ID NO: 231 - protein, 17 aa, Artificial
  FR or CDR or nanobody sequence
CISGSDGSTWYADSVAG

SEQ ID NO: 232 - protein, 17 aa, Artificial
  FR or CDR or nanobody sequence
CISSSDGSTYYADSVKG

SEQ ID NO: 233 - protein, 17 aa, Artificial
  FR or CDR or nanobody sequence
CISSSTGSTYYADSVKG

SEQ ID NO: 234 - protein, 16 aa, Artificial
  FR or CDR or nanobody sequence
IIATDGSTNYADSVKG

SEQ ID NO: 235 - protein, 17 aa, Artificial
  FR or CDR or nanobody sequence
AINSGGGSTYYADSVKG

SEQ ID NO: 236 - protein, 17 aa, Artificial
  FR or CDR or nanobody sequence
GISSSDGNTYYADSVKG

SEQ ID NO: 237 - protein, 16 aa, Artificial
  FR or CDR or nanobody sequence
GIISGGSTNYADSVKG

SEQ ID NO: 238 - protein, 17 aa, Artificial
  FR or CDR or nanobody sequence
VISRSGSSTYYADSVKG

SEQ ID NO: 239 - protein, 17 aa, Artificial
  FR or CDR or nanobody sequence
ATITHGGTTNYADSVKG

SEQ ID NO: 240 - protein, 16 aa, Artificial
  FR or CDR or nanobody sequence
IITNHGSTNYADAVKG

SEQ ID NO: 241 - protein, 17 aa, Artificial
  FR or CDR or nanobody sequence
AINWSGNSTYYADSVKG

SEQ ID NO: 242 - protein, 17 aa, Artificial
  FR or CDR or nanobody sequence
AISWSGGGTDYVDSVKG

SEQ ID NO: 243 - protein, 17 aa, Artificial
  FR or CDR or nanobody sequence
CISTSDGSTYYADSVKG

SEQ ID NO: 244 - protein, 17 aa, Artificial
  FR or CDR or nanobody sequence
ALTWSGGSTYYADSVKG

SEQ ID NO: 245 - protein, 17 aa, Artificial
  FR or CDR or nanobody sequence
CISSSDGSTYYADSVKG

SEQ ID NO: 246 - protein, 32 aa, Artificial
  FR or CDR or nanobody sequence
RFTISRDDAKNTVYLQMNSLKPEDTAVYYCAA

SEQ ID NO: 247 - protein, 32 aa, Artificial
  FR or CDR or nanobody sequence
RFTISRDDAKNTVYLQMNSLKPEDTASYYCAA

SEQ ID NO: 248 - protein, 32 aa, Artificial
  FR or CDR or nanobody sequence
RFTISRDNAKNTVYLQMNSLKPEDTAAYYCAT

SEQ ID NO: 249 - protein, 32 aa, Artificial
  FR or CDR or nanobody sequence
RFTISRDNAKNTVYLQMNSLKPEDTAVYYCAT

SEQ ID NO: 250 - protein, 32 aa, Artificial; identical to SEQ ID NO: 12
  FR or CDR or nanobody sequence

SEQ ID NO: 251 - protein, 32 aa, Artificial
  FR or CDR or nanobody sequence
RFTVSRDNAKNTVYLQMNSLKPEDTAVYYCAT

SEQ ID NO: 252 - protein, 32 aa, Artificial; identical to SEQ ID NO: 251
  FR or CDR or nanobody sequence

SEQ ID NO: 253 - protein, 32 aa, Artificial
  FR or CDR or nanobody sequence
RFTISRDNAKNTVYLQMNSLKPEDTAVYYCVK

SEQ ID NO: 254 - protein, 32 aa, Artificial; identical to SEQ ID NO: 246
  FR or CDR or nanobody sequence

SEQ ID NO: 255 - protein, 32 aa, Artificial
  FR or CDR or nanobody sequence
RFTISRDNAKNTLYLQMNSLKPEDTAVYYCAT

SEQ ID NO: 256 - protein, 32 aa, Artificial
  FR or CDR or nanobody sequence
RFTISSDNAKNTVYLQMNSLKPEDTAVYYCAA

SEQ ID NO: 257 - protein, 32 aa, Artificial; identical to SEQ ID NO: 255
  FR or CDR or nanobody sequence

SEQ ID NO: 258 - protein, 32 aa, Artificial; identical to SEQ ID NO: 256
  FR or CDR or nanobody sequence

SEQ ID NO: 259 - protein, 32 aa, Artificial; identical to SEQ ID NO: 255
  FR or CDR or nanobody sequence

SEQ ID NO: 260 - protein, 32 aa, Artificial
  FR or CDR or nanobody sequence
RFTISSDNAKNTVYLLMNSLKPEDTAVYYCAA

SEQ ID NO: 261 - protein, 32 aa, Artificial; identical to SEQ ID NO: 255
  FR or CDR or nanobody sequence

SEQ ID NO: 262 - protein, 32 aa, Artificial; identical to SEQ ID NO: 255
  FR or CDR or nanobody sequence

SEQ ID NO: 263 - protein, 32 aa, Artificial; identical to SEQ ID NO: 12
  FR or CDR or nanobody sequence

SEQ ID NO: 264 - protein, 32 aa, Artificial
  FR or CDR or nanobody sequence
RFTISRDNAKNTGYLQMNSLKPEDTAVYYCAA

SEQ ID NO: 265 - protein, 32 aa, Artificial; identical to SEQ ID NO: 249
  FR or CDR or nanobody sequence

SEQ ID NO: 266 - protein, 32 aa, Artificial; identical to SEQ ID NO: 12
  FR or CDR or nanobody sequence

SEQ ID NO: 267 - protein, 32 aa, Artificial; identical to SEQ ID NO: 253
  FR or CDR or nanobody sequence

SEQ ID NO: 268 - protein, 32 aa, Artificial; identical to SEQ ID NO: 255
  FR or CDR or nanobody sequence

SEQ ID NO: 269 - protein, 32 aa, Artificial; identical to SEQ ID NO: 255
  FR or CDR or nanobody sequence

SEQ ID NO: 270 - protein, 32 aa, Artificial; identical to SEQ ID NO: 255
  FR or CDR or nanobody sequence

SEQ ID NO: 271 - protein, 32 aa, Artificial; identical to SEQ ID NO: 255
  FR or CDR or nanobody sequence

SEQ ID NO: 272 - protein, 32 aa, Artificial
  FR or CDR or nanobody sequence
RFTISRDNAKNTFYLQMNSLKPEDTAVYYCAA

SEQ ID NO: 273 - protein, 32 aa, Artificial; identical to SEQ ID NO: 255
  FR or CDR or nanobody sequence

SEQ ID NO: 274 - protein, 32 aa, Artificial; identical to SEQ ID NO: 246
  FR or CDR or nanobody sequence

SEQ ID NO: 275 - protein, 32 aa, Artificial; identical to SEQ ID NO: 253
  FR or CDR or nanobody sequence

SEQ ID NO: 276 - protein, 32 aa, Artificial
  FR or CDR or nanobody sequence
RFTISRDNAKNTVYLQMNSLKPEDTAIYYCNA

SEQ ID NO: 277 - protein, 32 aa, Artificial; identical to SEQ ID NO: 256
  FR or CDR or nanobody sequence

SEQ ID NO: 278 - protein, 32 aa, Artificial; identical to SEQ ID NO: 276
  FR or CDR or nanobody sequence

SEQ ID NO: 279 - protein, 32 aa, Artificial; identical to SEQ ID NO: 276
  FR or CDR or nanobody sequence

SEQ ID NO: 280 - protein, 32 aa, Artificial; identical to SEQ ID NO: 248
  FR or CDR or nanobody sequence

SEQ ID NO: 281 - protein, 32 aa, Artificial; identical to SEQ ID NO: 12
  FR or CDR or nanobody sequence

SEQ ID NO: 282 - protein, 32 aa, Artificial
  FR or CDR or nanobody sequence
RFTISFDNAKNTVYLQMNSLKPEDTGLYICAV

SEQ ID NO: 283 - protein, 32 aa, Artificial; identical to SEQ ID NO: 12
  FR or CDR or nanobody sequence

SEQ ID NO: 284 - protein, 32 aa, Artificial
  FR or CDR or nanobody sequence
RFTISRDNGKNTVYLQMNSLKPEDTAVYYCAA

SEQ ID NO: 285 - protein, 32 aa, Artificial
  FR or CDR or nanobody sequence
RFTISRDNAKNTVYLQMNSLKPEDTAVYYCNL

SEQ ID NO: 286 - protein, 32 aa, Artificial; identical to SEQ ID NO: 255
  FR or CDR or nanobody sequence

SEQ ID NO: 287 - protein, 32 aa, Artificial; identical to SEQ ID NO: 256
  FR or CDR or nanobody sequence

SEQ ID NO: 288 - protein, 32 aa, Artificial
  FR or CDR or nanobody sequence
RLTISRDNAKNTVYLQMNSLKPEDTAVYYCSF

SEQ ID NO: 289 - protein, 32 aa, Artificial
  FR or CDR or nanobody sequence
RFTISRDNAKNTVYLQMNSLKPEDTAIYYCKA

SEQ ID NO: 290 - protein, 32 aa, Artificial
  FR or CDR or nanobody sequence
RFTISRDNRKNTVYLQMNSLKPEDTGVYYCNA

SEQ ID NO: 291 - protein, 32 aa, Artificial
  FR or CDR or nanobody sequence
RFTISRDYAKNTVYLQMNGLKPDDTAVYYCNA

SEQ ID NO: 292 - protein, 32 aa, Artificial
  FR or CDR or nanobody sequence
RFTVSRDNAKNTVYLQMNSLKPEDTAVYYCHA

SEQ ID NO: 293 - protein, 32 aa, Artificial
  FR or CDR or nanobody sequence
RFTISRDTAKNTMYLQMNSLKPEDTAIYYCNA

SEQ ID NO: 294 - protein, 32 aa, Artificial
  FR or CDR or nanobody sequence
RFTISRDNAKNTVYLQMNSLKPEDTAVYYCTA

SEQ ID NO: 295 - protein, 32 aa, Artificial
  FR or CDR or nanobody sequence
RFTISRDSAKNTVYLQMNKLKPEDTAVYYCVA

SEQ ID NO: 296 - protein, 32 aa, Artificial
  FR or CDR or nanobody sequence
RFTISSDNAKNTVYLQMNSLKPEDTAVYFCTA

SEQ ID NO: 297 - protein, 24 aa, Artificial
  FR or CDR or nanobody sequence
DGHLNWGQRYVPCSQISWRGWNDY

SEQ ID NO: 298 - protein, 24 aa, Artificial
  FR or CDR or nanobody sequence
DGHLNWGQPYVPCSQISWRGWNDY

SEQ ID NO: 299 - protein, 16 aa, Artificial
  FR or CDR or nanobody sequence
DRSVYYCSGDAPEEYY

SEQ ID NO: 300 - protein, 16 aa, Artificial
  FR or CDR or nanobody sequence
DRSVYYCSGGAPEEYY

SEQ ID NO: 301 - protein, 17 aa, Artificial
  FR or CDR or nanobody sequence
DLLRTPEFCVDSAPYDY

SEQ ID NO: 302 - protein, 16 aa, Artificial
  FR or CDR or nanobody sequence
DRSVYYCSGGAPEEYY

SEQ ID NO: 303 - protein, 16 aa, Artificial
  FR or CDR or nanobody sequence
DRSVYYCSGGAPEEYY

SEQ ID NO: 304 - protein, 18 aa, Artificial
  FR or CDR or nanobody sequence
GSTAIVGVPPTYPDEYDY

SEQ ID NO: 305 - protein, 24 aa, Artificial
  FR or CDR or nanobody sequence
DGHLNWGQRYVPCSQISWRGWNDY

SEQ ID NO: 306 - protein, 17 aa, Artificial
  FR or CDR or nanobody sequence
DWRYSDYDLPLPPPGDY

SEQ ID NO: 307 - protein, 18 aa, Artificial
  FR or CDR or nanobody sequence
EPPDSSWILDGSPEFFKF

SEQ ID NO: 308 - protein, 17 aa, Artificial
  FR or CDR or nanobody sequence
DWRYSDYDLPLPPPGDY

SEQ ID NO: 309 - protein, 18 aa, Artificial
  FR or CDR or nanobody sequence
EPPDSNWYLDGSPEFFKF

SEQ ID NO: 310 - protein, 17 aa, Artificial
  FR or CDR or nanobody sequence
DWRYSDYDLPLPPPGDY

SEQ ID NO: 311 - protein, 18 aa, Artificial
  FR or CDR or nanobody sequence
EPPDSMWSLDGSPEFFKF

SEQ ID NO: 312 - protein, 17 aa, Artificial
  FR or CDR or nanobody sequence
DWRYSDYDLPLPPPGDY

SEQ ID NO: 313 - protein, 17 aa, Artificial
  FR or CDR or nanobody sequence
DWRYSDYDLPLPPPGDY

SEQ ID NO: 314 - protein, 17 aa, Artificial
  FR or CDR or nanobody sequence
DLLRTPEFCVDSAPYDY

SEQ ID NO: 315 - protein, 17 aa, Artificial
  FR or CDR or nanobody sequence
DLLRTPEFCSDSAPYDY

SEQ ID NO: 316 - protein, 16 aa, Artificial
  FR or CDR or nanobody sequence
DRSVYYCSGGAPEEYY

SEQ ID NO: 317 - protein, 17 aa, Artificial
  FR or CDR or nanobody sequence
DLLRTPEFCTDSAPYDY

SEQ ID NO: 318 - protein, 18 aa, Artificial
  FR or CDR or nanobody sequence
GSTAIVGVPPTYPDEYDY

SEQ ID NO: 319 - protein, 17 aa, Artificial
  FR or CDR or nanobody sequence
DWRYSDYDLPLPPPGDY

SEQ ID NO: 320 - protein, 17 aa, Artificial
  FR or CDR or nanobody sequence
DWRYSDYDLPLPPPGDY

SEQ ID NO: 321 - protein, 17 aa, Artificial
  FR or CDR or nanobody sequence
DWRYSDYDLPLPPPGDY

SEQ ID NO: 322 - protein, 17 aa, Artificial
  FR or CDR or nanobody sequence
DWRYSDYDLPLPPPGDY

SEQ ID NO: 323 - protein, 18 aa, Artificial
  FR or CDR or nanobody sequence
EGLGDSDSPCGAAWYNDY

SEQ ID NO: 324 - protein, 17 aa, Artificial
  FR or CDR or nanobody sequence
DWRYSDYDLPLPPPGDY

SEQ ID NO: 325 - protein, 24 aa, Artificial
  FR or CDR or nanobody sequence
DGHLNWGQRYVPCSQISWRGWNDY

SEQ ID NO: 326 - protein, 18 aa, Artificial
  FR or CDR or nanobody sequence
GSTAIVGVPPTYPDEYDY

SEQ ID NO: 327 - protein, 10 aa, Artificial
  FR or CDR or nanobody sequence
QYGLGYAEDY

SEQ ID NO: 328 - protein, 18 aa, Artificial
  FR or CDR or nanobody sequence
ERDVPARSLCGSYYWYDY

SEQ ID NO: 329 - protein, 11 aa, Artificial
  FR or CDR or nanobody sequence
FLPGPEGFHDY

SEQ ID NO: 330 - protein, 8 aa, Artificial
  FR or CDR or nanobody sequence
YTGGGDDY

SEQ ID NO: 331 - protein, 16 aa, Artificial
  FR or CDR or nanobody sequence
DRSVYYCSGGAPEEYY

SEQ ID NO: 332 - protein, 13 aa, Artificial
  FR or CDR or nanobody sequence
DLAEFKYSDYADY

SEQ ID NO: 333 - protein, 14 aa, Artificial
  FR or CDR or nanobody sequence
TGGVRGPCAYEYEY

SEQ ID NO: 334 - protein, 17 aa, Artificial
  FR or CDR or nanobody sequence
DLLRTPEFCVDSAPYDY

SEQ ID NO: 335 - protein, 21 aa, Artificial
  FR or CDR or nanobody sequence
DKMWSPCLVAANEEALFEYDY

SEQ ID NO: 336 - protein, 9 aa, Artificial
  FR or CDR or nanobody sequence
FSLRLGRDY

SEQ ID NO: 337 - protein, 17 aa, Artificial
  FR or CDR or nanobody sequence
DWRYSDYDLPLPPPGDY

SEQ ID NO: 338 - protein, 18 aa, Artificial
  FR or CDR or nanobody sequence
EPPDSSWYLDGSPEFFKY

SEQ ID NO: 339 - protein, 13 aa, Artificial
  FR or CDR or nanobody sequence
VTTNSDYDLGRDY

SEQ ID NO: 340 - protein, 9 aa, Artificial
  FR or CDR or nanobody sequence
EVVAGDYDY

SEQ ID NO: 341 - protein, 9 aa, Artificial
  FR or CDR or nanobody sequence
RSSWYSPEY

SEQ ID NO: 342 - protein, 12 aa, Artificial
  FR or CDR or nanobody sequence
YISEVGTWRDDY

SEQ ID NO: 343 - protein, 7 aa, Artificial
  FR or CDR or nanobody sequence
FRDDYYS

SEQ ID NO: 344 - protein, 13 aa, Artificial
  FR or CDR or nanobody sequence
LGTTDSDYEGELY

SEQ ID NO: 345 - protein, 21 aa, Artificial
  FR or CDR or nanobody sequence
DGGPHAPLTVQDMCVMAIADY

SEQ ID NO: 346 - protein, 15 aa, Artificial
  FR or CDR or nanobody sequence
DEEIHLIVSISIADF

SEQ ID NO: 347 - protein, 15 aa, Artificial
  FR or CDR or nanobody sequence
LFDRCGSTWYYGMDY

SEQ ID NO: 348 - protein, 11 aa, Artificial
  FR or CDR or nanobody sequence
WGQGTQVTVSS

SEQ ID NO: 349 - protein, 11 aa, Artificial
  FR or CDR or nanobody sequence
WGQGTQVTVSS

SEQ ID NO: 350 - protein, 11 aa, Artificial
  FR or CDR or nanobody sequence
WGQGTQVTVSS

SEQ ID NO: 351 - protein, 11 aa, Artificial
  FR or CDR or nanobody sequence
WGQGTQVTVSS

SEQ ID NO: 352 - protein, 11 aa, Artificial
  FR or CDR or nanobody sequence
WGRGTQVTVSS

SEQ ID NO: 353 - protein, 11 aa, Artificial
  FR or CDR or nanobody sequence
WGQGTQVTVSS

SEQ ID NO: 354 - protein, 11 aa, Artificial
  FR or CDR or nanobody sequence
WGQGTQVTVSS

SEQ ID NO: 355 - protein, 11 aa, Artificial
  FR or CDR or nanobody sequence
WGQGTQVTVSS

SEQ ID NO: 356 - protein, 11 aa, Artificial
  FR or CDR or nanobody sequence
WGQGTQVTVSS

SEQ ID NO: 357 - protein, 11 aa, Artificial
  FR or CDR or nanobody sequence
WGQGTQVTVSS

SEQ ID NO: 358 - protein, 11 aa, Artificial
  FR or CDR or nanobody sequence
WGQGTQVTVSS

SEQ ID NO: 359 - protein, 11 aa, Artificial
  FR or CDR or nanobody sequence
WGQGTQVTVSS

SEQ ID NO: 360 - protein, 11 aa, Artificial
  FR or CDR or nanobody sequence
WGQGTQVTVSS

SEQ ID NO: 361 - protein, 11 aa, Artificial
  FR or CDR or nanobody sequence
WGQGTQVTVSS

SEQ ID NO: 362 - protein, 11 aa, Artificial
  FR or CDR or nanobody sequence
WGQGTQVTVSS

SEQ ID NO: 363 - protein, 11 aa, Artificial
  FR or CDR or nanobody sequence
WGQGTQVTVSS

SEQ ID NO: 364 - protein, 11 aa, Artificial
  FR or CDR or nanobody sequence
WGQGTQVTVSS

SEQ ID NO: 365 - protein, 11 aa, Artificial
  FR or CDR or nanobody sequence
WGQGTQVTVSS

SEQ ID NO: 366 - protein, 11 aa, Artificial
  FR or CDR or nanobody sequence
WGQGTQVTVSS

SEQ ID NO: 367 - protein, 11 aa, Artificial
  FR or CDR or nanobody sequence
WGQGTQVTVSS

SEQ ID NO: 368 - protein, 11 aa, Artificial
  FR or CDR or nanobody sequence
WGQGTQVTVSS

SEQ ID NO: 369 - protein, 11 aa, Artificial
  FR or CDR or nanobody sequence
WGQGTQVTVSS

SEQ ID NO: 370 - protein, 11 aa, Artificial
  FR or CDR or nanobody sequence
WGQGTQVTVSS

SEQ ID NO: 371 - protein, 11 aa, Artificial
  FR or CDR or nanobody sequence
WGQGTQVTVSS

SEQ ID NO: 372 - protein, 11 aa, Artificial
  FR or CDR or nanobody sequence
WGQGTQVTVSS

SEQ ID NO: 373 - protein, 11 aa, Artificial
  FR or CDR or nanobody sequence
WGQGTQVTVSS

SEQ ID NO: 374 - protein, 11 aa, Artificial
  FR or CDR or nanobody sequence
WGQGTQVTVSS

SEQ ID NO: 375 - protein, 11 aa, Artificial
  FR or CDR or nanobody sequence
WGQGTQVTVSS

SEQ ID NO: 376 - protein, 11 aa, Artificial
  FR or CDR or nanobody sequence
WGQGTQVTVSS

SEQ ID NO: 377 - protein, 11 aa, Artificial
  FR or CDR or nanobody sequence
WGQGTQVTVSS

SEQ ID NO: 378 - protein, 11 aa, Artificial
  FR or CDR or nanobody sequence
WGQGTQVTVSS

SEQ ID NO: 379 - protein, 11 aa, Artificial
  FR or CDR or nanobody sequence
RGQGTQVTVSS

SEQ ID NO: 380 - protein, 11 aa, Artificial
  FR or CDR or nanobody sequence
WGQGTQVTVSS

SEQ ID NO: 381 - protein, 11 aa, Artificial
  FR or CDR or nanobody sequence
WGQGTQVTVSS

SEQ ID NO: 382 - protein, 11 aa, Artificial
  FR or CDR or nanobody sequence
WGQGTQVTVSS

SEQ ID NO: 383 - protein, 11 aa, Artificial
  FR or CDR or nanobody sequence
WGQGTQVTVSS

SEQ ID NO: 384 - protein, 11 aa, Artificial
  FR or CDR or nanobody sequence
WGQGTQVTVSS

SEQ ID NO: 385 - protein, 11 aa, Artificial
  FR or CDR or nanobody sequence
WGQGTQVTVSS

SEQ ID NO: 386 - protein, 11 aa, Artificial
  FR or CDR or nanobody sequence
WGQGTQVTVSS

SEQ ID NO: 387 - protein, 11 aa, Artificial
  FR or CDR or nanobody sequence
WGQGTQVTVSS

SEQ ID NO: 388 - protein, 11 aa, Artificial
  FR or CDR or nanobody sequence
WGQGTQVTVSS

SEQ ID NO: 389 - protein, 11 aa, Artificial
  FR or CDR or nanobody sequence
WGQGTQVTVSS

SEQ ID NO: 390 - protein, 11 aa, Artificial
  FR or CDR or nanobody sequence
WGQGTQVTVSS

SEQ ID NO: 391 - protein, 11 aa, Artificial
  FR or CDR or nanobody sequence
WGQGTQVTVSS

SEQ ID NO: 392 - protein, 11 aa, Artificial
  FR or CDR or nanobody sequence
WGQGTQVTVSS

SEQ ID NO: 393 - protein, 11 aa, Artificial
  FR or CDR or nanobody sequence
WGQGIQVTVSS

SEQ ID NO: 394 - protein, 11 aa, Artificial
  FR or CDR or nanobody sequence
EGKGTLVTVSS

SEQ ID NO: 395 - protein, 11 aa, Artificial
  FR or CDR or nanobody sequence
WGQGTQVTVSS

SEQ ID NO: 396 - protein, 11 aa, Artificial
  FR or CDR or nanobody sequence
WGQGTQVTVSS

SEQ ID NO: 397 - protein, 11 aa, Artificial
  FR or CDR or nanobody sequence
WGQGTQVTVSS

SEQ ID NO: 398 - protein, 11 aa, Artificial
  FR or CDR or nanobody sequence
WGKGTLVTVSS

SEQ ID NO: 399 - protein, 135 aa, Artificial
  FR or CDR or nanobody sequence
EVQLVESGGGLVQPGGSLRLSCAASGFSLDYYAIGWFRQAPGKEREGVSCMDSSAGTTSTYYSDSVKGRFTISRDDAKNTVYLQMNSLKPEDTAVYYCAADGHLNWGQRYVPCSQISWRGWNDYWGQGTQVTVSS

SEQ ID NO: 400 - protein, 135 aa, Artificial
  FR or CDR or nanobody sequence
EVQLVESGGGLVQPGGSLRLSCAASGFSLDYYAIGWFRQAPGKEREGVSCMDSSDGTTNTYYSDSVKGRFTISRDDAKNTVYLQMNSLKPEDTASYYCAADGHLNWGQPYVPCSQISWRGWNDYWGQGTQVTVSS

SEQ ID NO: 401 - protein, 125 aa, Artificial
  FR or CDR or nanobody sequence
EVQLVESGGGLVQPGGSLRLSCAASGFTLDYYAIGWFRQAPGKEREGVSCISSSDGSTYYADSVKGRFTISRDNAKNTVYLQMNSLKPEDTAAYYCATDRSVYYCSGDAPEEYYWGQGTQVTVSS

SEQ ID NO: 402 - protein, 125 aa, Artificial
  FR or CDR or nanobody sequence
EVQLVESGGGLVQPGGSLRLSCAASGFTLDYFAIGWFRQAPGKERERVSCISSSDGSTYYADSVKGRFTISRDNAKNTVYLQMNSLKPEDTAVYYCATDRSVYYCSGGAPEEYYWGQGTQVTVSS

SEQ ID NO: 403 - protein, 126 aa, Artificial
  FR or CDR or nanobody sequence
EVQLVESGGGLVQPGGSLRLSCVASGFSLDYYVIGWFRQAPGKEREGVSCISSSDGSTYYADSVKGRFTISRDNAKNTVYLQMNSLKPEDTAVYYCAADLLRTPEFCVDSAPYDYWGRGTQVTVSS

SEQ ID NO: 404 - protein, 125 aa, Artificial
  FR or CDR or nanobody sequence
EVQLVESGGGLVQPGGSLRLSCAASGFTLGYFAIGWFRQAPGKEREGVSCISSSDGSTYYADSVKGRFTVSRDNAKNTVYLQMNSLKPEDTAVYYCATDRSVYYCSGGAPEEYYWGQGTQVTVSS

SEQ ID NO: 405 - protein, 125 aa, Artificial
  FR or CDR or nanobody sequence
EVQLVESGGGLVQPGGSLRLSCAASGFTLGYFAIGWFRQAPGKEREGVSCISSSDGSAYYADSVKGRFTVSRDNAKNTVYLQMNSLKPEDTAVYYCATDRSVYYCSGGAPEEYYWGQGTQVTVSS

SEQ ID NO: 406 - protein, 127 aa, Artificial
  FR or CDR or nanobody sequence
EVQLVESGGGLVQPGGSLRLSCAASGFTFDDYGMSWVRQAPGKGLEWVSAISWNGGSTYYTESMKGRFTISRDNAKNTVYLQMNSLKPEDTAVYYCVKGSTAIVGVPPTYPDEYDYWGQGTQVTVSS

SEQ ID NO: 407 - protein, 135 aa, Artificial
  FR or CDR or nanobody sequence
EVQLVESGGGLVQPGGSLRLSCAASGFSLDYYAIGWFRQAPGKEREGVSCMDSSGGTTSTYYSDSVKGRFTISRDDAKNTVYLQMNSLKPEDTAVYYCAADGHLNWGQRYVPCSQISWRGWNDYWGQGTQVTVSS

SEQ ID NO: 408 - protein, 126 aa, Artificial
  FR or CDR or nanobody sequence
EVQLVESGGGLVQPGGSLRLSCAASGFTFGSYDMSWVRQAPGKGPEWVSAINSGGGSTYYADSVKGRFTISRDNAKNTLYLQMNSLKPEDTAVYYCATDWRYSDYDLPLPPPGDYWGQGTQVTVSS

SEQ ID NO: 409 - protein, 127 aa, Artificial
  FR or CDR or nanobody sequence
EVQLVESGGGLVQAGGSLRLSCAASGFTFDDYAIGWFRQAPGKEREGISCISSSDGSTYYADSVKGRFTISSDNAKNTVYLQMNSLKPEDTAVYYCAAEPPDSSWILDGSPEFFKFWGQGTQVTVSS

SEQ ID NO: 410 - protein, 126 aa, Artificial; identical to SEQ ID NO: 408
  FR or CDR or nanobody sequence

SEQ ID NO: 411 - protein, 127 aa, Artificial
  FR or CDR or nanobody sequence
EVQLVESGGGLVQAGGSLRLSCAASGFTFDDYAIGWFRQAPGKEREGVSGISSSDGNTYYADSVKGRFTISSDNAKNTVYLQMNSLKPEDTAVYYCAAEPPDSNWYLDGSPEFFKFWGQGTQVTVSS

SEQ ID NO: 412 - protein, 126 aa, Artificial; identical to SEQ ID NO: 408
  FR or CDR or nanobody sequence

SEQ ID NO: 413 - protein, 127 aa, Artificial
  FR or CDR or nanobody sequence
EVQLVESGGGLVQAGGSLRLSCAASGFTFDDYAIGWFRQAPGKEREGVSCISSSDGSTYYADSVKGRFTISSDNAKNTVYLLMNSLKPEDTAVYYCAAEPPDSMWSLDGSPEFFKFWGQGTQVTVSS

SEQ ID NO: 414 - protein, 126 aa, Artificial; identical to SEQ ID NO: 408
  FR or CDR or nanobody sequence

SEQ ID NO: 415 - protein, 126 aa, Artificial; identical to SEQ ID NO: 408
  FR or CDR or nanobody sequence

SEQ ID NO: 416 - protein, 126 aa, Artificial
  FR or CDR or nanobody sequence
EVQLVESGGGLVQPGGSLRLSCVASGFSLDYYVIGWFRQAPGKEREGVSCISSSDGSTYYADSVKGRFTISRDNAKNTVYLQMNSLKPEDTAVYYCAADLLRTPEFCVDSAPYDYWGQGTQVTVSS

SEQ ID NO: 417 - protein, 126 aa, Artificial
  FR or CDR or nanobody sequence
EVQLVESGGGLVQPGGSLRLSCAASGFTLDYYVIGWFRQAPGKEREAVACISSSDRSTYYADSVKGRFTISRDNAKNTGYLQMNSLKPEDTAVYYCAADLLRTPEFCSDSAPYDYWGQGTQVTVSS

SEQ ID NO: 418 - protein, 125 aa, Artificial
  FR or CDR or nanobody sequence
EVQLVESGGGLVQPGGSLRLSCAASGFTLDYYAIGWWRQAPGKGREGVSCISSGDGSTNYADSVKGRFTISRDNAKNTVYLQMNSLKPEDTAVYYCATDRSVYYCSGGAPEEYYWGQGTQVTVSS

SEQ ID NO: 419 - protein, 126 aa, Artificial
  FR or CDR or nanobody sequence
EVQLVESGGGLVQPGGSLRLSCAASGFTLDYYVIGWFRQAPGKEREGVSCIGSSDDSTYYADSVKGRFTISRDNAKNTVYLQMNSLKPEDTAVYYCAADLLRTPEFCTDSAPYDYWGQGTQVTVSS

SEQ ID NO: 420 - protein, 127 aa, Artificial; identical to SEQ ID NO: 406
  FR or CDR or nanobody sequence

SEQ ID NO: 421 - protein, 126 aa, Artificial; identical to SEQ ID NO: 408
  FR or CDR or nanobody sequence

SEQ ID NO: 422 - protein, 126 aa, Artificial; identical to SEQ ID NO: 408
  FR or CDR or nanobody sequence

SEQ ID NO: 423 - protein, 126 aa, Artificial; identical to SEQ ID NO: 408
  FR or CDR or nanobody sequence

SEQ ID NO: 424 - protein, 126 aa, Artificial
  FR or CDR or nanobody sequence
EVQLVESGGGLVQPGGSLRLSCAASGFTFGSYDMSWVRQAPGKGPEWVSAINSGGDNTYYADSVKGRFTISRDNAKNTLYLQMNSLKPEDTAVYYCATDWRYSDYDLPLPPPGDYWGQGTQVTVSS

SEQ ID NO: 425 - protein, 127 aa, Artificial
  FR or CDR or nanobody sequence
EVQLVESGGGLVQPGGSLRLSCAASGFTLNYYAIGWFRQAPGKEREGVSCISSSDGSTYYADSVKGRFTISRDNAKNTFYLQMNSLKPEDTAVYYCAAEGLGDSDSPCGAAWYNDYWGQGTQVTVSS

SEQ ID NO: 426 - protein, 126 aa, Artificial; identical to SEQ ID NO: 408
  FR or CDR or nanobody sequence

SEQ ID NO: 427 - protein, 135 aa, Artificial
  FR or CDR or nanobody sequence
EVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSS

SEQ ID NO: 428 - protein, 127 aa, Artificial
  FR or CDR or nanobody sequence
EVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSS

SEQ ID NO: 429 - protein, 118 aa, Artificial
  FR or CDR or nanobody sequence
EVQLVESGGGLVQAGGSLRLSCAASGRTFSSYDMGWYRQAPGKEREFVAIITWNSSTYYADSVKGRFTISRDNAKNTVYLQMNSLKPEDTAIYYCNAQYGLGYAEDYWGQGTQVTVSS

SEQ ID NO: 430 - protein, 127 aa, Artificial
  FR or CDR or nanobody sequence
EVQLVESGGGLVQAGGSLRLSCAASGFTFDDYAIGWFRQAPGKEHEGVSCISSSDGSTYYADSVKGRFTISSDNAKNTVYLQMNSLKPEDTAVYYCAAERDVPARSLCGSYYWYDYRGQGTQVTVSS

SEQ ID NO: 431 - protein, 120 aa, Artificial
  FR or CDR or nanobody sequence
EVQLVESGGGLVQAGGSLRLSCAASGRTFSSYDMGWYRQAPGKEREFVAVIHWSSGSTYYADPVKGRFTISRDNAKNTVYLQMNSLKPEDTAIYYCNAFLPGPEGFHDYWGQGTQVTVSS

SEQ ID NO: 432 - protein, 117 aa, Artificial
  FR or CDR or nanobody sequence
EVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSS

SEQ ID NO: 433 - protein, 125 aa, Artificial
  FR or CDR or nanobody sequence
EVQLVESGGGLVQPGGSLRLSCAASGFTLDYYAIGWFRQAPGKERERVSCISSSDGSTYYADSVKGRFTISRDNAKNTVYLQMNSLKPEDTAAYYCATDRSVYYCSGGAPEEYYWGQGTQVTVSS

SEQ ID NO: 434 - protein, 122 aa, Artificial
  FR or CDR or nanobody sequence
EVQLVESGGGLVQAGGSLRLSCAASGRTFSSYAMGWGRQAPGKEREFVATISWSGGSTYYADSVKGRFTISRDNAKNTVYLQMNSLKPEDTAVYYCAADLAEFKYSDYADYWGQGTQVTVSS

SEQ ID NO: 435 - protein, 123 aa, Artificial
  FR or CDR or nanobody sequence
EVQLVESGGGLVQPGGSLRLSCAAAGFTLDYSAIGWFRQAPGKEREMFSCISGSDGSTWYADSVAGRFTISFDNAKNTVYLQMNSLKPEDTGLYICAVTGGVRGPCAYEYEYWGQGTQVTVSS

SEQ ID NO: 436 - protein, 126 aa, Artificial; identical to SEQ ID NO: 416
  FR or CDR or nanobody sequence

SEQ ID NO: 437 - protein, 130 aa, Artificial
  FR or CDR or nanobody sequence
EVQLVESGGGLVQPGGSLRLSCAASGFTLDYGAIGWFRQAPGKEREGVSCISSSTGSTYYADSVKGRFTISRDNGKNTVYLQMNSLKPEDTAVYYCAADKMWSPCLVAANEEALFEYDYWGQGTQVTVSS

SEQ ID NO: 438 - protein, 119 aa, Artificial
  FR or CDR or nanobody sequence
EVQLVESGGGLVQAGGSLRLSCAASGNIFDDNTMGWTWNRQPPGKQRELVAIIATDGSTNYADSVKGRFTISRDNAKNTVYLQMNSLKPEDTAVYYCNLFSLRLGRDYWGQGTQVTVSS

SEQ ID NO: 439 - protein, 126 aa, Artificial; identical to SEQ ID NO: 408
  Nanobody sequence

SEQ ID NO: 440 - protein, 127 aa, Artificial
  Nanobody sequence
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSS

SEQ ID NO: 441 - protein, 121 aa, Artificial
  Nanobody sequence
EVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSS

SEQ ID NO: 442 - protein, 118 aa, Artificial
  Nanobody sequence
EVQLVESGGGLVQAGGSLRLSCAASGRTFSSYDMGWYRQAPGKEREFVAVISRSGSSTYYADSVKGRFTISRDNAKNTVYLQMNSLKPEDTAIYYCKAEVVAGDYDYWGQGTQVTVSS

SEQ ID NO: 443 - protein, 117 aa, Artificial
  Nanobody sequence
EVQLVESGGGLVQAGGSLRLSCTASGNIFSTETMGWYRQPPGKQRDVVATITHGGTTNYADSVKGRFTISRDNRKNTVYLQMNSLKPEDTGVYYCNARSSWYSPEYWGQGTQVTVSS

SEQ ID NO: 444 - protein, 120 aa, Artificial
  Nanobody sequence
EVQLVESGGGFVQAGGSLRLSCIASGDNFSINRMGWYRQALGKQRELVAIITNHGSTNYADAVKGRFTISRDYAKNTVYLQMNGLKPDDTAVYYCNAYISEVGTWRDDYWGQGIQVTVSS

SEQ ID NO: 445 - protein, 116 aa, Artificial
  Nanobody sequence
EVQLVESGGGLVQAGGSLRLSCAASGRTFSGADAGWNRQTPGKEREFVAAINWSGNSTYYADSVKGRFTVSRDNAKNTVYLQMNSLKPEDTAVYYCHAFRDDYYSEGKGTLVTVSS

SEQ ID NO: 446 - protein, 122 aa, Artificial
  Nanobody sequence
EVQLVESGGGLVQAGGSLRLSCAASGRTLSSYDMGWYRQGPGKEREFVAAISWSGGGTDYVDSVKGRFTISRDTAKNTMYLQMNSLKPEDTAIYYCNALGTTDSDYEGELYWGQGTQVTVSS

SEQ ID NO: 447 - protein, 130 aa, Artificial
  Nanobody sequence
EVQLVESGGGLVQPGGSLRLSCAASGFTLDSYAIGWFRQAPGKEPEGVSCISTSDGSTYYADSVKGRFTISRDNAKNTVYLQMNSLKPEDTAVYYCTADGGPHAPLTVQDMCVMAIADYWGQGTQVTVSS

SEQ ID NO: 448 - protein, 124 aa, Artificial
  Nanobody sequence
EVQLVESGGGLVQAGGSLRLSCAASGRTFSNIAMGWIREAPGKEREFVAALTWSGGSTYYADSVKGRFTISRDSAKNTVYLQMNKLKPEDTAVYYCVADEEIHLIVSISIADFWGQGTQVTVSS

SEQ ID NO: 449 - protein, 124 aa, Artificial
  Nanobody sequence
EVQLVESGGGLVQAGGSLRLSCAASGLTDDDFAIGWFRQAPGKEPEGVSCISSSDGSTYYADSVKGRFTISSDNAKNTVYLQMNSLKPEDTAVYFCTALFDRCGSTWYYGMDYWGKGTLVTVSS

SEQ ID NO: 450 - protein, 244 aa, Artificial
  Nanobody sequence
EVQLVESGGGLVQAGGSLRLSCAASGRTFSSYDMGWYRQAPGKEREFVAVIHWSSGSTYYADPVKGRFTISRDNAKNTVYLQMNSLKPEDTAIYYCNAFLPGPEGFHDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 451 - protein, 241 aa, Artificial
  Nanobody sequence
EVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 452 - protein, 249 aa, Artificial
  Nanobody sequence
EVQLVESGGGLVQPGGSLRLSCAASGFTLDYYAIGWFRQAPGKERERVSCISSSDGSTYYADSVKGRFTISRDNAKNTVYLQMNSLKPEDTAAYYCATDRSVYYCSGGAPEEYYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 453 - protein, 250 aa, Artificial
  Nanobody sequence
EVQLVESGGGLVQPGGSLRLSCVASGFSLDYYVIGWFRQAPGKEREGVSCISSSDGSTYYADSVKGRFTISRDNAKNTVYLQMNSLKPEDTAVYYCAADLLRTPEFCVDSAPYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 454 - protein, 245 aa, Artificial
  Nanobody sequence
EVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 455 - protein, 259 aa, Artificial
  Nanobody sequence
EVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 456 - protein, 242 aa, Artificial
  Nanobody sequence
EVQLVESGGGLVQAGGSLRLSCAASGRTFSSYDMGWYRQAPGKEREFVAIITWNSSTYYADSVKGRFTISRDNAKNTVYLQMNSLKPEDTAIYYCNAQYGLGYAEDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 457 - protein, 251 aa, Artificial
  Nanobody sequence
EVQLVESGGGLVQAGGSLRLSCAASGFTFDDYAIGWFRQAPGKEHEGVSCISSSDGSTYYADSVKGRFTISSDNAKNTVYLQMNSLKPEDTAVYYCAAERDVPARSLCGSYYWYDYRGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 458 - protein, 246 aa, Artificial
  Nanobody sequence
EVQLVESGGGLVQAGGSLRLSCAASGRTFSSYAMGWGRQAPGKEREFVATISWSGGSTYYADSVKGRFTISRDNAKNTVYLQMNSLKPEDTAVYYCAADLAEFKYSDYADYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 459 - protein, 247 aa, Artificial
  Nanobody sequence
EVQLVESGGGLVQPGGSLRLSCAAAGFTLDYSAIGWFRQAPGKEREMFSCISGSDGSTWYADSVAGRFTISFDNAKNTVYLQMNSLKPEDTGLYICAVTGGVRGPCAYEYEYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 460 - protein, 254 aa, Artificial
  Nanobody sequence
EVQLVESGGGLVQPGGSLRLSCAASGFTLDYGAIGWFRQAPGKEREGVSCISSSTGSTYYADSVKGRFTISRDNGKNTVYLQMNSLKPEDTAVYYCAADKMWSPCLVAANEEALFEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 461 - protein, 243 aa, Artificial
  Nanobody sequence
EVQLVESGGGLVQAGGSLRLSCAASGNIFDDNTMGWTWNRQPPGKQRELVAIIATDGSTNYADSVKGRFTISRDNAKNTVYLQMNSLKPEDTAVYYCNLFSLRLGRDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 462 - protein, 250 aa, Artificial
  Nanobody sequence
EVQLVESGGGLVQPGGSLRLSCAASGFTFGSYDMSWVRQAPGKGPEWVSAINSGGGSTYYADSVKGRFTISRDNAKNTLYLQMNSLKPEDTAVYYCATDWRYSDYDLPLPPPGDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 463 - protein, 251 aa, Artificial
  Nanobody sequence
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 464 - protein, 242 aa, Artificial
  Nanobody sequence
EVQLVESGGGLVQAGGSLRLSCAASGRTFSSYDMGWYRQAPGKEREFVAVISRSGSSTYYADSVKGRFTISRDNAKNTVYLQMNSLKPEDTAIYYCKAEVVAGDYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 465 - protein, 241 aa, Artificial
  Nanobody sequence
EVQLVESGGGLVQAGGSLRLSCTASGNIFSTETMGWYRQPPGKQRDVVATITHGGTTNYADSVKGRFTISRDNRKNTVYLQMNSLKPEDTGVYYCNARSSWYSPEYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 466 - protein, 244 aa, Artificial
  Nanobody sequence
EVQLVESGGGFVQAGGSLRLSCIASGDNFSINRMGWYRQALGKQRELVAIITNHGSTNYADAVKGRFTISRDYAKNTVYLQMNGLKPDDTAVYYCNAYISEVGTWRDDYWGQGIQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 467 - protein, 240 aa, Artificial
  Nanobody sequence
EVQLVESGGGLVQAGGSLRLSCAASGRTFSGADAGWNRQTPGKEREFVAAINWSGNSTYYADSVKGRFTVSRDNAKNTVYLQMNSLKPEDTAVYYCHAFRDDYYSEGKGTLVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 468 - protein, 246 aa, Artificial
  Nanobody sequence
EVQLVESGGGLVQAGGSLRLSCAASGRTLSSYDMGWYRQGPGKEREFVAAISWSGGGTDYVDSVKGRFTISRDTAKNTMYLQMNSLKPEDTAIYYCNALGTTDSDYEGELYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 469 - protein, 254 aa, Artificial
  Nanobody sequence
EVQLVESGGGLVQPGGSLRLSCAASGFTLDSYAIGWFRQAPGKEPEGVSCISTSDGSTYYADSVKGRFTISRDNAKNTVYLQMNSLKPEDTAVYYCTADGGPHAPLTVQDMCVMAIADYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 470 - protein, 248 aa, Artificial
  Nanobody sequence
EVQLVESGGGLVQAGGSLRLSCAASGRTFSNIAMGWIREAPGKEREFVAALTWSGGSTYYADSVKGRFTISRDSAKNTVYLQMNKLKPEDTAVYYCVADEEIHLIVSISIADFWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 471 - protein, 248 aa, Artificial
  Nanobody sequence
EVQLVESGGGLVQAGGSLRLSCAASGLTDDDFAIGWFRQAPGKEPEGVSCISSSDGSTYYADSVKGRFTISSDNAKNTVYLQMNSLKPEDTAVYFCTALFDRCGSTWYYGMDYWGKGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 472 - protein, 22 aa, Artificial
  leader sequence
VKKLLFAIPLVVPFYAAQPAMA

SEQ ID NO: 473 - protein, 22 aa, Artificial
  leader sequence
VKKLLFAIPLVVPFYAAQPAIA

SEQ ID NO: 474 - protein, 9 aa, Artificial
  leader sequence
FELASVAQA

SEQ ID NO: 475 - protein, 21 aa, Artificial
  leader sequence
MKKTAIAIAVALAGLATVAQA

SEQ ID NO: 476 - protein, 21 aa, Artificial
  leader sequence
MKKTAIAFAVALAGLATVAQA

SEQ ID NO: 477 - protein, 23 aa, Artificial
  leader sequence
AAAEQKLISEEDLNGAAHHHHHH

SEQ ID NO: 478 - protein, 375 aa, Artificial
  Nanobody sequence
EVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSS

SEQ ID NO: 479 - protein, 387 aa, Artificial
  Nanobody sequence
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSS

SEQ ID NO: 480 - protein, 367 aa, Artificial
  Nanobody sequence
EVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSS

SEQ ID NO: 481 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSS

SEQ ID NO: 482 - protein, 403 aa, Artificial
  Nanobody sequence
EVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSS

SEQ ID NO: 483 - protein, 375 aa, Artificial
  Nanobody sequence
AVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSSGGGGSGGGSEVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSS

SEQ ID NO: 484 - protein, 387 aa, Artificial
  Nanobody sequence
AVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSGGGGSGGGSEVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSS

SEQ ID NO: 485 - protein, 367 aa, Artificial
  Nanobody sequence
AVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSSGGGGSGGGSEVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSS

SEQ ID NO: 486 - protein, 387 aa, Artificial
  Nanobody sequence
AVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSS

SEQ ID NO: 487 - protein, 403 aa, Artificial
  Nanobody sequence
AVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSSGGGGSGGGSEVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSS

SEQ ID NO: 488 - protein, 375 aa, Artificial
  Nanobody sequence
EVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSSGGGGSGGGSEVQLVESGGGLVQAGGSLRLSCAASGSIFKVNAMGWYRQAPGKQRELVAGIISGGSTNYADSVKGRLTISRDNAKNTVYLQMNSLKPEDTAVYYCSFVTTNSDYDLGRDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 489 - protein, 387 aa, Artificial
  Nanobody sequence
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSGGGGSGGGSEVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 490 - protein, 367 aa, Artificial
  Nanobody sequence
EVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSSGGGGSGGGSEVQLVESGGGLVQAGGSLRLSCAASGRTSSSYDMTWYRQVPGKEREFVAVISWSGGSTYYADSVKGRFTISRDNAKNTVYLQMNSLKPEDTAIYYCNAYTGGGDDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 491 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLKPEDTAVYYCVKGSTAIVGVPPTYPDEYDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 492 - protein, 403 aa, Artificial
  Nanobody sequence
EVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSSGGGGSGGGSEVQLVESGGGLVQPGGSLRLSCAASGFSLDYYAIGWFRQAPGKEREGVSCMDSSSGTTSTYYSDSVKGRFTISRDDAKNTVYLQMNSLKPEDTAVYYCAADGHLNWGQRYVPCSQISWRGWNDYWGQGTQVTVSSGGGGSGGGSAVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 493 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSS

SEQ ID NO: 494 - protein, 375 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSS

SEQ ID NO: 495 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSS

SEQ ID NO: 496 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSS

SEQ ID NO: 497 - protein, 375 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSS

SEQ ID NO: 498 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 499 - protein, 387 aa, Artificial
  Nanobody sequence
EVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 500 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSS

SEQ ID NO: 501 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSS

SEQ ID NO: 502 - protein, 387 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 503 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 504 - protein, 387 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 505 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 506 - protein, 387 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 507 - protein, 387 aa, Artificial
  Nanobody sequence
EVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 508 - protein, 387 aa, Artificial
  Nanobody sequence
EVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 509 - protein, 387 aa, Artificial
  Nanobody sequence
EVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 510 - protein, 387 aa, Artificial
  Nanobody sequence
EVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 511 - protein, 387 aa, Artificial
  Nanobody sequence
EVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 512 - protein, 387 aa, Artificial
  Nanobody sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 513 - protein, 387 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 514 - protein, 387 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSS

SEQ ID NO: 515 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 516 - protein, 375 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 517 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 518 - protein, 375 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 519 - protein, 375 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 520 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 521 - protein, 387 aa, Artificial
  Nanobody sequence
EVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 522 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 523 - protein, 387 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 524 - protein, 387 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 525 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 526 - protein, 387 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 527 - protein, 387 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 528 - protein, 387 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 529 - protein, 387 aa, Artificial
  Nanobody sequence
EVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 530 - protein, 387 aa, Artificial
  Nanobody sequence
EVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 531 - protein, 387 aa, Artificial
  Nanobody sequence
EVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 532 - protein, 387 aa, Artificial
  Nanobody sequence
EVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 533 - protein, 387 aa, Artificial
  Nanobody sequence
EVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 534 - protein, 387 aa, Artificial
  Nanobody sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 535 - protein, 387 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 536 - protein, 387 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 537 - protein, 375 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSS

SEQ ID NO: 538 - protein, 375 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSS

SEQ ID NO: 539 - protein, 375 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSS

SEQ ID NO: 540 - protein, 375 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSS

SEQ ID NO: 541 - protein, 375 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSGGGGSGGGSEVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSS

SEQ ID NO: 542 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 543 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 544 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSS

SEQ ID NO: 545 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSS

SEQ ID NO: 546 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 547 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 548 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 549 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 550 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 551 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 552 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 553 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 554 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 555 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 556 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 557 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 558 - protein, 387 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSS

SEQ ID NO: 559 - protein, 245 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 560 - protein, 245 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 561 - protein, 245 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 562 - protein, 245 aa, Artificial
  Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 563 - protein, 245 aa, Artificial
  Nanobody sequence
EVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 564 - protein, 251 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 565 - protein, 251 aa, Artificial
  Nanobody sequence
EVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 566 - protein, 251 aa, Artificial
  Nanobody sequence
EVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 567 - protein, 251 aa, Artificial
  Nanobody sequence
EVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 568 - protein, 251 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 569 - protein, 251 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 570 - protein, 251 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 571 - protein, 251 aa, Artificial
  Nanobody sequence
EVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 572 - protein, 251 aa, Artificial
  Nanobody sequence
EVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 573 - protein, 251 aa, Artificial
  Nanobody sequence
EVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 574 - protein, 251 aa, Artificial
  Nanobody sequence
EVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 575 - protein, 251 aa, Artificial
  Nanobody sequence
EVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 576 - protein, 251 aa, Artificial
  Nanobody sequence
EVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 577 - protein, 251 aa, Artificial
  Nanobody sequence
EVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 578 - protein, 251 aa, Artificial
  Nanobody sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 579 - protein, 251 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 580 - protein, 251 aa, Artificial
  Nanobody sequence
EVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 581 - protein, 245 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSS

SEQ ID NO: 582 - protein, 245 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSS

SEQ ID NO: 583 - protein, 245 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSS

SEQ ID NO: 584 - protein, 245 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSS

SEQ ID NO: 585 - protein, 245 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSS

SEQ ID NO: 586 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 587 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 588 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSS

SEQ ID NO: 589 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSS

SEQ ID NO: 590 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 591 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 592 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 593 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 594 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 595 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 596 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 597 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 598 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 599 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 600 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 601 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 602 - protein, 251 aa, Artificial
  Nanobody sequence
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYGMSWVRQAPGKGTEWVSAISWNGNNTYYTESMKGRFTISRDNAKNTLYLQMNSLRPEDTAVYYCAKGSTAIVGVPPTYPDEYDYWGQGTLVTVSS

SEQ ID NO: 603 - protein, 726 aa, Artificial
  Nanobody sequence
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGSGGSGGSGGSGGEVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSS

SEQ ID NO: 604 - protein, 712 aa, Artificial
  Nanobody sequence
EVQLVESGGGLVQAGGSLRLSCAASGFTFDDYDIGWFRQAPGKEREGVSGISSSDGNTYYADSVKGRFTISSDNAKNTVYLQMNSLKPEDTAVYYCAAEPPDSSWYLDGSPEFFKYWGQGTQVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 605 - protein, 712 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 606 - protein, 848 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 607 - protein, 850 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSGGGGSGGGGSGGGGSGGGGSEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLV

SEQ ID NO: 608 - protein, 842 aa, Artificial
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSAAAEVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 609 - protein, 121 aa, Artificial
  CDR, FR or Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCSFVTTNSDYDLGRDYWGQGTLVTVSS

SEQ ID NO: 610 - protein, 121 aa, Artificial
  CDR, FR or Nanobody sequence
EVQLVESGGGLVQPGGSLRLSCAASGSIFKVNAMGWYRQAPGKGRELVAGIISGGSTNYADSVKGRFTISRDNAKNTVYLQMNSLRPEDTAVYYCSFVTTNSDYDLGRDYWGQGTLVTVSS

SEQ ID NO: 611 - protein, 121 aa, Artificial
  CDR, FR or Nanobody sequence
EVQLVESGGGLVQPGGSLRLSCAASGSIFKVNAMGWYRQAPGKGRELVAGIISGGSTNYADSVKGRLTISRDNAKNTLYLQMNSLRPEDTAVYYCSFVTTNSDYDLGRDYWGQGTLVTVSS

SEQ ID NO: 612 - protein, 121 aa, Artificial
  CDR, FR or Nanobody sequence
EVQLVESGGGLVQPGGSLRLSCAASGSIFKVNAMGWYRQAPGKGRELVAGIISGGSTNYADSVKGRLTISRDNAKNTVYLQMNSLRPEDTAVYYCAFVTTNSDYDLGRDYWGQGTLVTVSS

SEQ ID NO: 613 - protein, 121 aa, Artificial
  CDR, FR or Nanobody sequence
EVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSS

SEQ ID NO: 614 - protein, 127 aa, Artificial
  CDR, FR or Nanobody sequence
EVQLVESGGGLVQPGGSLRLSCAASGFTFDDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 615 - protein, 127 aa, Artificial
  CDR, FR or Nanobody sequence
EVQLVESGGGLVQPGGSLRLSCAASGFTFSDYDIGWFRQAPGKGREGVSGISSSDGNTYYADSVKGRFTISSDNAKNTVYLQMNSLRPEDTAVYYCAAEPPDSSWYLDGSPEFFKYWGQGTLVTVSS

SEQ ID NO: 616 - protein, 127 aa, Artificial
  CDR, FR or Nanobody sequence
EVQLVESGGGLVQPGGSLRLSCAASGFTFDDYDIGWFRQAPGKGREGVSGISSSDGNTYYADSVKGRFTISRDNAKNTVYLQMNSLRPEDTAVYYCAAEPPDSSWYLDGSPEFFKYWGQGTLVTVSS

SEQ ID NO: 617 - protein, 127 aa, Artificial
  CDR, FR or Nanobody sequence
EVQLVESGGGLVQPGGSLRLSCAASGFTFDDYDIGWFRQAPGKGREGVSGISSSDGNTYYADSVKGRFTISSDNAKNTLYLQMNSLRPEDTAVYYCAAEPPDSSWYLDGSPEFFKYWGQGTLVTVSS

SEQ ID NO: 618 - protein, 127 aa, Artificial
  CDR, FR or Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 619 - protein, 127 aa, Artificial
  CDR, FR or Nanobody sequence
EVQLVESGGGLVQPGGSLRLSCAASGFTFDDYGMSWVRQAPGRATEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 620 - protein, 127 aa, Artificial
  CDR, FR or Nanobody sequence
EVQLVESGGGLVQPGGSLRLSCAASGFTFDDYGMSWVRQAPGKGLEWVSAISWNGNNTYYTESMKGRFTISRDNAKNTVYLQMNSLRPEDTAVYYCVKGSTAIVGVPPTYPDEYDYWGQGTLVTVSS

SEQ ID NO: 621 - protein, 127 aa, Artificial
  CDR, FR or Nanobody sequence
EVQLVESGGGLVQPGGSLRLSCAASGFTFDDYGMSWVRQAPGRATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 622 - protein, 127 aa, Artificial
  CDR, FR or Nanobody sequence
EVQLVESGGGLVQPGGSLRLSCAASGFTFDDYGMSWVRQAPGKGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 623 - protein, 127 aa, Artificial
  CDR, FR or Nanobody sequence
EVQLVESGGGLVQPGGSLRLSCAASGFTFDDYGMSWVRQAPGRGLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 624 - protein, 127 aa, Artificial
  CDR, FR or Nanobody sequence
EVQLVESGGGLVQPGGSLRLSCAASGFTFDDYGMSWVRQAPGRALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 625 - protein, 127 aa, Artificial
  CDR, FR or Nanobody sequence
EVQLVESGGGLVQPGGSLRLSCAASGFTFDDYGMSWVRQAPGKATEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 626 - protein, 127 aa, Artificial
  CDR, FR or Nanobody sequence
EVQLVESGGGLVQPGGSLRLSCAASGFTFDDYGMSWVRQAPGKGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 627 - protein, 127 aa, Artificial
  CDR, FR or Nanobody sequence
EVQLVESGGGLVQPGGSLRLSCAASGFTFDDYGMSWVRQAPGRGTEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 628 - protein, 127 aa, Artificial
  CDR, FR or Nanobody sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 629 - protein, 449 aa, Artificial
  Reference IgG heavy chain
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 630 - protein, 214 aa, Artificial [sequence omitted]

SEQ ID NO: 631 - protein, 222 aa, Artificial
  Reference Fab heavy chain
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 632 - protein, 214 aa, Artificial [sequence omitted]

SEQ ID NO: 633 - protein, 339 aa, Artificial
  IL6R sequence macaca fascicularis
LAPGGCPAQEVARGVLTSLPGDSVTLTCPGGEPEDNATVHWVLRKPAEGSHLSRWAGVGRRLLLRSVQLHDSGNYSCYRAGRPAATVHLLVDVPPEEPQLSCFRKSPLSNVVCEWGPRSTPSPTTKAVLLVRKFQNSPAEDFQEPCQYSQESQKFSCQLAVPEGDSSFYIVSMCVASSVGSKLSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPTQAPTTNKDDDNILSGDSANATSLPVQD

SEQ ID NO: 634 - DNA, 56 bp, Artificial Sequence
  Primer
gggtatctctcgagaaaagagaggctgaagctgaggtgcagctggtggagtctggg

SEQ ID NO: 635 - DNA, 70 bp, Artificial Sequence
  Primer
tctcttctcctaggtctttgaatctgtgggcgacttcagatttatgagcatctgaggagacggtgacctg

SEQ ID NO: 636 - DNA, 65 bp, Artificial Sequence
  Primer
gtggatccggaggcagtggaggttctggtgggtcaggaggtgaggtgcagctggtggagtctggg

SEQ ID NO: 637 - DNA, 42 bp, Artificial Sequence
  Primer
tagaaagctggcggccgcttattatgaggagacggtgacctg

SEQ ID NO: 638 - DNA, 52 bp, Artificial Sequence
  Primer
ttggttgcggccagtcaggccgcacttggtttgggtggatccggaggcagtg

SEQ ID NO: 639 - DNA, 42 bp, Artificial Sequence; identical to SEQ ID NO: 637
  Primer

SEQ ID NO: 640 - protein, 135 aa, Artificial Sequence
  Nanobody sequence
EVQLVESGGGLVQPGGSLRLSCAASGFSLDYYAIGWFRQAPGKEREGVSCMDSSDGTTRTYYSDSVKGRFTISRDDAKNTVYLQMNSLKPEDTAVYYCAADGHLNWGQRYVPCSQISWRGWNDYWGQGTQVTVSS

SEQ ID NO: 641 - protein, 125 aa, Artificial Sequence
  Nanobody sequence
EVQLVESGGGLVQPGGSLRLSCAASGFTLDYFAIGWWRQAPGKGREGVSCISSGDGSTNYADSVKGRFTISRDNAKNTVYLQMNSLKPEDTAVYYCATDRSVYYCSGGAPEEYYWGQGTQVTVSS

SEQ ID NO: 642 - protein, 125 aa, Artificial Sequence
  Nanobody sequence
EVQLVESGGGWVQPGGSLRLSCAASGFTLDYFAIGWWRQAPGKGREGVSCISSGDGSTNYADSVKGRFTISRDNAKNTVYLQMNSLKPEDTAVYYCATDRSVYYCSGGAPEEYYWGQGTQVTVSS

SEQ ID NO: 643 - protein, 127 aa, Artificial Sequence
  Nanobody sequence
EVQLVESGGGLVQAGGSLRLSCAASGFTFDDYAIGWFRQAPGKEHEGVSCISSDDGSTYYADFVKGRFTISSDNAQNTVYLQMNSLKPEDTAVYYCAAQRDVPARSLCGSYYWYDYRGQGTQVTVSS

SEQ ID NO: 644 - protein, 119 aa, Artificial Sequence
  Nanobody sequence
EVQLVESGGGLVQAGGSLRLSCAASGGTFSSYDMGWYRQAPGKEREFVAFINWSGSSTYYADSVKGRFTISRDNAKNTVYLQMNSLKSEDTAIYYCNAQYGLGYAEDYWGQGTQVTVSS

SEQ ID NO: 645 - protein, 128 aa, Artificial Sequence
  Nanobody sequence
EVQLVESGGGLVQPGGSLRLSCAASGFPLDYYAIGWFRQAPGKEREGVSCISSSDGSTYYADSVKGRFTISRDNAKNTVYLQMNSLKPEDTAVYYCALVHTTAQATGVPQREYEYEWWGQGTQVTVSS

SEQ ID NO: 646 - protein, 124 aa, Artificial Sequence
  Nanobody sequence
EVQLVESGGGLVQAGGSLRLSCAASGLTDDDFAIGWFRQAPGKEPEGVSCISSSDGSTYYADSVKGRFTISSDNAKNTVYLQMNSLKPEDTAVYFCTALFDRCGSTWYYGMDYWGKGTQVTVSS

SEQ ID NO: 647 - protein, 116 aa, Artificial Sequence
  Nanobody sequence
EVQLVESGGGLVQAGGSLRLSCAASGRTFSGADAGWNRQTPGKEREFVAAINWSGNSTYYADSVKGRFTVSRDNAKNTVYLQMNSLKPEDTAVYYCHAFRDDYYSEGKGTQVTVSS

SEQ ID NO: 648 - protein, 137 aa, Artificial Sequence
  Nanobody sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSAAAEQKLISE

SEQ ID NO: 649 - protein, 144 aa, Artificial Sequence
  Nanobody sequence
EVQLVESGGGLVQPGGSLRLSCAASGSIFKVNAMGWYRQAPGKGRELVAGIISGGSTNYADSVKGRFTISRDNAKNTLYLQMNSLRPEDTAVYYCAFVTTNSDYDLGRDYWGQGTLVTVSSAAAEQKLISEEDLNGAAHHHHHH

The invention claimed is:

1. An isolated amino acid sequence that can specifically bind to IL-6R, and that essentially consists of 4 framework regions (FR1 to FR4, respectively) and 3 complementarity determining regions (CDR1 to CDR3, respectively), in which:
   CDR1 is SEQ ID NO: 135;
   CDR2 is SEQ ID NO: 237; and
   CDR3 is SEQ ID NO: 339.

2. The isolated amino acid sequence according to claim 1, that essentially consists of a domain antibody, an amino acid sequence that is suitable for use as a domain antibody, a single domain antibody, an amino acid sequence that is suitable for use as a single domain antibody, a $V_{HH}$ sequence, a humanized $V_{HH}$ sequence, or a camelized $V_{HH}$ sequence.

3. An isolated amino acid sequence that can specifically bind to IL-6R, and that essentially consists of 4 framework regions (FR1 to FR4, respectively) and 3 complementarity determining regions (CDR1 to CDR3, respectively), in which:
   CDR1 is chosen from
   SEQ ID NO:135 or
   amino acid sequences that have 3, 2, or 1 amino acid difference with SEQ ID NO:135 and that is derived from SEQ ID NO: 135 by means of affinity maturation; and
   CDR2 is chosen from
   the amino acid sequences of SEQ ID NO:237 or
   amino acid sequences that have 3, 2, or 1 amino acid difference with SEQ ID NO237 and that is derived from SEQ ID NO: 237 by means of affinity maturation; and
   CDR3 is chosen from
   SEQ ID NO:339 or
   amino acid sequences that have 3, 2, or 1 amino acid difference with SEQ ID NO339 and that is derived from SEQ ID NO: 339 by means of affinity maturation.

4. The isolated amino acid sequence according to claim 3, that essentially consists of a heavy chain variable domain sequence that is derived from a conventional four-chain antibody or that essentially consist of a heavy chain variable domain sequence that is derived from a heavy chain antibody.

5. The isolated amino acid sequence according to claim 3, that essentially consists of a humanized $V_{HH}$ sequence.

6. The isolated amino acid sequence according to claim 3, that essentially consists of a $V_{HH}$ sequence, of a humanized $V_{HH}$ sequence or of a camelized $V_H$ sequence in which:
   one or more of the amino acid residues at positions 11, 37, 44, 45, 47, 83, 84, 103, 104 and 108 according to the Kabat numbering are chosen from:
   at position 11: L, M, S, V, W,
   at position 37: F, Y, H, I, L, V,
   at position 44: G, E, A, D, Q, R, S, L,
   at position 45: L, R, C, I, L, P, Q, V,
   at position 47: W, L, F, A, G, I, M, R, S, V, Y,
   at position 83: R, K, N, E, G, I, M, Q, T,
   at position 84: P, A, L, R, S, T, D, V,
   at position 103: W, P, R, S,
   at position 104: G, D, and
   at position 108: Q, L, R.

7. A compound or construct, that comprises one or more amino acid sequences according to claim 3, and optionally further comprises one or more other groups, residues, moieties or binding units, optionally linked via one or more linkers.

8. The compound or construct according to claim 7, which is a multivalent construct.

9. The compound or construct according to claim 7, which is a multispecific construct.

10. The compound or construct according to claim 7, which has an increased half-life, compared to the corresponding amino acid sequence.

11. The compound or construct according to claim 7, in which said one or more other groups, residues, moieties or binding units provide the compound or construct with increased half-life, compared to the corresponding amino acid sequence.

12. The compound or construct according to claim 11, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

13. The compound or construct according to claim 11, in which said one or more other groups, residues, moieties or binding units that provide the compound or construct with increased half-life is chosen from the group consisting of human serum albumin or fragments thereof.

14. The compound or construct according to claim 11, in which said one or more other groups, residues, moieties or binding units that provide the compound or construct with increased half-life are chosen from the group consisting of binding units that can bind to serum albumin, human serum albumin, a serum immunoglobulin, or IgG.

15. The compound or construct according to claim 14, in which said one or more other groups, residues, moieties or binding units that provide the compound or construct with increased half-life are chosen from the group consisting of domain antibodies, amino acid sequences that are suitable for use as a domain antibody, single domain antibodies, amino acid sequences that are suitable for use as a single domain antibody, $V_{HH}$ sequences, humanized $V_{HH}$ sequences and camelized $V_H$ sequences, that can bind to serum albumin, human serum albumin, a serum immunoglobulin, or IgG.

16. The compound or construct according to claim 15, in which said one or more other groups, residues, moieties or binding units that provide the compound or construct with increased half-life is a $V_{HH}$ sequence, a humanized $V_{HH}$ sequence or a camelized $V_H$ sequence that can bind to serum albumin, human serum albumin, a serum immunoglobulin, or IgG.

17. The compound or construct according to claim 11, that has a serum half-life that is at least 1.5 times greater than the half-life of the corresponding amino acid sequence.

18. The compound or construct according to claim 7, that has a serum half-life that is increased more than 1 hour compared to the corresponding amino acid sequence.

19. The compound or construct according to claim 7, that has a serum half-life in human of at least about 12 hours.

20. A monovalent construct, essentially consisting of one amino acid sequence according to claim 3.

21. The monovalent construct according to claim 20, in which said amino acid sequence of the invention is chosen from the group consisting of domain antibodies, amino acid sequences that are suitable for use as a domain antibody, single domain antibodies, amino acid sequences that are suitable for use as a single domain antibody, $V_{HH}$ sequences, humanized $V_{HH}$ sequences and camelized $V_H$ sequences.

22. A composition, comprising at least one amino acid sequence according to claim 3.

* * * * *

UNITED STATES PATENT AND TRADEMARK OFFICE
CERTIFICATE OF CORRECTION

PATENT NO. : 8,629,244 B2
APPLICATION NO. : 12/310223
DATED : January 14, 2014
INVENTOR(S) : Joost Alexander Kolkman et al.

Page 1 of 1

It is certified that error appears in the above-identified patent and that said Letters Patent is hereby corrected as shown below:

In the Claims: Beginning in column 195, line 47, continuing to line 43, in column 196, Claims 2-3 are corrected to read as follows:

2. The isolated amino acid sequence according to claim 1, that essentially consists of a domain antibody, an amino acid sequence that is suitable for use as a domain antibody, a single domain antibody, an amino acid sequence that is suitable for use as a single domain antibody, a $V_{HH}$ sequence, a humanized $V_{HH}$ sequence, or a camelized $V_H$ sequence.

3. An isolated amino acid sequence that can specifically bind to IL-6R, and that essentially consists of 4 framework regions (FR1 to FR4, respectively) and 3 complementarity determining regions (CDR1 to CDR3, respectively), in which:

CDR1 is chosen from SEQ ID NO:135 or amino acid sequences that have 3, 2, or 1 amino acid difference with SEQ ID NO:135 and that is derived from SEQ ID NO:135 by means of affinity maturation;

and

CDR2 is chosen from the amino acid sequences of SEQ ID NO:237 or amino acid sequences that have 3, 2, or 1 amino acid difference with SEQ ID NO:237 and that is derived from SEQ ID NO:237 by means of affinity maturation;

and

CDR3 is chosen from SEQ ID NO:339 or amino acid sequences that have 3, 2, or 1 amino acid difference with SEQ ID NO:339 and that is derived from SEQ ID NO:339 by means of affinity maturation.

Signed and Sealed this
Twelfth Day of August, 2014

Michelle K. Lee
*Deputy Director of the United States Patent and Trademark Office*

UNITED STATES PATENT AND TRADEMARK OFFICE
CERTIFICATE OF CORRECTION

PATENT NO. : 8,629,244 B2
APPLICATION NO. : 12/310223
DATED : January 14, 2014
INVENTOR(S) : Kolkman et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1109 days.

Signed and Sealed this
Thirtieth Day of May, 2017

Michelle K. Lee
*Director of the United States Patent and Trademark Office*